United States Patent 9,719,064 (GENOMICS OF ACTINOPLANES UTAHENSIS) - sequence listing, part 5

SEQ ID NO: 13792 - protein, 2523 aa, Actinoplanes utahensis
MRTTAPGVVEIVSPSPRSVVEALQQGRECGFLGIEEQAEGPRPRAAHVFQTTMADAEMDATLRALRRAARRDLLEQGVATLYLGLGTVRWRDGANEHISPILLIPVDLITPDPEDYPRLRVRAEDPMVNPALDICLRRHSIELPAVDSLAALDVTVFWARLDAALGDHPDWHSDESVLLARFAVHREVMYTDLLDHERQILSHPVVRALATAPEAQADAFKFEVISGRRIDEVAAPDDVPLVLDADAAQRACIIAALHGRSFVMRGAPGTGKSQTIANMVAGLLHAGRRVLLVAEKAAALDTVRERLEPAGLHDYLLELHSGRTGRDHVAAALAAALDFIPLPPPDLSTDEREALREHRQRLNAYAEAMNEVREPLGHRLHDVLGMCAQMTDVPQAPAPAELPIPLTTQSLQRVRDAAERLGRNWRPAREGDDFLWHDVIDRNRLDARLHQAQAALDHLCEAIERDPLADAFLISSIGEAITLTTLVGHAARRPAEAADDWLTMASLEPVARAAEGLLRHLKTLHQAEDAVRAKAGATWSALPAPAKLPIIPTLLHLNPPAVELLPLTAAQARGLARRFADEADRLEQHQHSLDRVTARLGLPNVVAFTDLPRLTAIVDLLSRPDKPEPAWFDSLGMNAAHAAMRNLRRVVNVVKAAESRAREHFSDNALVEPVDELAERFAHQHKGLRKLSAQSRRDKKAAADIARPDVKRSQAVANLNAAAAWKRALQELAEAEQEYAGILGKHWQGQDTDFDAIERALRTAAQTLEVTPPEALPTLIERICAPTPNSAIIRIVGEAGKEFERWTAALRPPPEPAPRPQLATGPIHDAVTWLRAHVEPFTAVAELVQAYSAAAGRDFTLAEAAAIGLLRESASEAAAALSANAKEYAKVLGPAYRGTQTDVEALATAMAWTSEARRIRNGADIAFTLEQAELLSRTRPSDTLPARVAEWQAARDWILRAFAPSRHPALSAALDERDTSRELLRELLDDTRGQQEWFDCQTARAVLAEHGLDPVVDFCIREDLPVEQLLPVLGRALFQSWADAIIRSDDRLAPLDAVSRDRLVDEFRLWDAGLQRAAAAEVMNAVDALQPAEAAAGEAAMLRAAAAQQGRRLPVRDLFARTARAAMAVKPCLVMSPADVSRLLPPDLHFDVVIIDEASRVPVPDAITCAYRGNALVVCGDDRQLTATPIPGGDSRSILEQALSCDAFRVLDLTTHYRSRDESLIAFANHAFYQGRLHTFPAFAPAGPDRGVQLYPAIGDMPLADLVATRVAHHFVTRPDLSLGVVVCTAEDGYEIEAAVADMIVPPEDDRLRGFFIKGLDAVQGDERDVVIFAINGDLDGLSGPDGWRRLNVATTRARRRLEVVSAVRARDLSENDVSLRHLADFLEYAARGIHALGLEDSHPGESQTPFEDSVRDVIRGWGYRVSTRVGAGAYRIDLAVRRSARRNAPYALGIECDGTTYDSAPTARDRDRIREQVLDSLGWKLHRIWGTAWYLDRDREETRLLAAIQDAFAGLPDEEAPPELGVATAPDQPEDIAHAAPAPADAVEYPVAEAAEGYGAGYADTAGETPAPRTTRLAYDEVVAAVPAAQAAPSSGTVYATAAAPVSTFTQAASDEQVRTFTGSAFTESASAEPVARVTTESSGGGYPDASADSGLDLAEREGLFAWTDADDAGVAQTEAAAEADLADAHDADDRRVTEAALIAGLGLRGSRASSTGMPTTGDVAEFEESAGPPDDGALDERVPLMGGDLPAQSVGATPDEPVVAETSEAGIAVSAGERLAHADHSGLAGVAAEFAFAQAGAEELAAAEAYLGANLEAAIAQLRAGGSESAEWPVEPDGAPAEPAMTATHADSGAAARTDTAATSDDNGSWSAPAMDNPVRAEWPFASRAESPSRSDWSAAAESHPEPPVPGSDPAVGSPLQPLAVGSEADRSIAEAGVDWSADAEEAVVEVQEESTIRAEWPFASRAEAPERVAWPAAGDRPGVQEISWPTADRNTGDQEPRVQDVAWPTAERPGGTRAGREPEVREVAWPTTGQPTSREPQVRNVEWPVAEREERTAADREPRVQRVEWPTATREEGVQWSAATDEPIQPAGRRVSSVEWPTAGAEPAERRVSSVEWPAATREEPAQGTAWPSDTRAREAGTVSWPVVSRDDQTSASREDLAEVAARFGVGTEELAAAAAQFLAGLHETAEPADRLDAISQIRAELTESANLEPELADAAAAVAEQSLLGVRAERPDWFLEMVGQPDLAAAVAEFEETMAAPPGWTHPSVATTGPHLAGAHQPDPVLGSETMLQEETRQDVTARAAETTGAAGAHTGEWAHPYRKADLPPLPAGAVLTDPSLRPELIAAVRRLAEIEGPVHINVALQRMREQWDLARISRPARTAIEAAIEEAGVAWDGTFLGDPDQDIPVVRQRADGVARKADQVSDAELAIALENLVIDGGVLPVDELLAAVTKLYGWSSRRSAELDARLTGMMADLVAEGHLLQQPNGLAAAHGLPDPLQLSRHESGHRHAHHTTRH

SEQ ID NO: 13793 - protein, 259 aa, Actinoplanes utahensis
MRVHHLNCGTLRPPGGDLVCHVLLAESDAGLVLIDTGFGLADIADPATRIGPPRHLLRPALRRAETAVAQVERLGFRPSDVRHIVVTHFDIDHIGGLADFPHARVHVTAAEAEGALRAPTRGERRRFRSAQWSHGLDLVEHTADGERWRGFAAAKELTEIGPGVVLIPMPGHTRGHACVAVDSGDRWLLHCGDAFYHRNTLTGAPVPLGLRLAEIGVAFDRTLVRANHARLAALHQRAEPDLTLLSSHDPVIFASLAGH

SEQ ID NO: 13794 - protein, 238 aa, Actinoplanes utahensis
MTIGSEALRRDVWLANQVIPEAGLAQLTWGNVSGVDREGGFFLIKPSGVSYGDLTADMLVPVNLETGKVLAGDLRPSVDTESHRAFYLAWPSIGGITHTHSTNAVAFAQANRDIPVLGTTHADTFNGPVPVTRGLTAEECAHDYEFNTGRVIIELIGDDEAAAAMPAALVANHGPFTWGVSPKKSVEHAIIVEAVADMAIRTLAINPQAFTPQHLQERHFKRKHGPGAYYGNPGAAKA

SEQ ID NO: 13795 - protein, 283 aa, Actinoplanes utahensis
MSGLTTEPAVPGWWRRRHPRLSGTLHIRDNHGHDTTITLRGRGAVLTPAGNNLIGYGEIWAVHTDPETTTTSLMISYGRSPAPDDRETGLCPPGATVTLSGTHFTWHTPSQAPVPAEIPHQRTAELRSHDGPATNGPATTRRKPATPTAASHESTTATAAGHEQPTTPTAAGHEPATTTAANHEPTTATATRHQPTASDHEPTAGIAGTGTTDDSTAATAALGQTGAGSAGVRGNAAPTTSREPATRNTRVPLPRSGNRRAAIPGFRQRVSALVRDLTHPPAY

SEQ ID NO: 13796 - protein, 370 aa, Actinoplanes utahensis
MPTTDPAPDLGPAAQMPFTATRPRSGKERGSVMRDVAKLAGVSHQTVSRVINDHPNVRAETRERVLAAMRSLNYRRNLAARTLATRESRTLGIIGFETTLFGPESMLYGIESAARAAGYLVSVATVRELAHRPVLEAVDRLAQHDVDGIIAIAPKPAVTTALTHAPSGLACVAVGGAGTGADPFPTVRVDNAAGARLATRHLLDLGHATVHHAAGPPDWPEAQARVDGWRETLSAAGAAVPPITPGWWDAAAGYEQGRRLAADPAVTAVFCANDRIALGVLRALHEAGRRVPEDVSVVGFDDMPDSGYFLPPLTTIHQDFGEMGRRALALLLDHMAQEETDGPLSNVVVQPELVLRSSTGPRRPLTLGGE

SEQ ID NO: 13797 - protein, 327 aa, Actinoplanes utahensis
MAAALTGMLAVSALAGCGSKSDDAGSGSANSGGSGKKLVLGFSQVGAESGWRTANTKSIQEAAAAAGFELKFSDAQGKQENQISAIRSFITQHVDVIAFSPVVTSGWDSVLKDAKDAGIPVILTDRAVDSQDLSLYKSFLGSDFVKEGKEAGDWLVKQYEGKSDPVNVVELSGTTGSAPAIDRQKGFAQAITANPNIKIVKSQTGNFTRAEGKTTMQAILQSTPKIDVLYAHNDDMGLGAIEAIEAAGKKPGKDIKIITVDAVHDGMQALSDGKINYIVECSPLLGPQLMDLAKKVKDKQDVPQRVLTEETTFTQEQAKAALPTRKY

SEQ ID NO: 13798 - protein, 510 aa, Actinoplanes utahensis
MGEPATNPVLEMTGIRKVFPGVVALDGVDFRLYPGEVHALMGENGAGKSTLIKVLTGVYEIDGGEIRLGGDVVRIAGPLAAQKAGISTVYQEVNLCTNLTVAENIFIGREPRTFGKIRWGQMRRRATELLQRLDLDIDVSAPLSQYSLAIQQMVAIARAVDISARVLILDEPTSSLDTSEVEQLFRVMRRLKADGVAILFVSHFLDQIYEISDRLTVLRNGQLIGEYRTAELTQVQLVEKMIGKELATLEDLEDKAQSARTKAAAAEPILEARGLGRTGAIAPFDLTIHQGEVVGLAGLLGSGRTELARLLFGADKADQGTLSVDGKPVSLRDPQVAMKRGIAFSSENRRTEGIIGDLSVRENIILALQASRGWTRPIPRRKQDEIVDKYIKALQIRPADPERPVRNLSGGNQQKVLLARWLITEPRLLIIDEPTRGIDVGAKAEIQKLVAELSGGGMAVLFVSAELEEVLRLSHKIAVLRDRRLVEELDNTAGVDADRIMQTIASGATS

SEQ ID NO: 13799 - protein, 339 aa, Actinoplanes utahensis
MTILKNRLFWPTAILVAMLIVNVFTSHQFLTIHDGHLFGTLIDIIRGSAPLMLVALGMTLVISTGGIDLSVGSVMAISGAVACLLIKDLSDQNALGAVLLIVAVSIGVSAVLGLWNGALVAVVGIQPIIATLILMVAGRGLAQLITDGQIINVQSSPYASIATGFFLTLPVAFLIAMAAVALTAVLTRRTALGLLLESVGGSPAASRLAGIRARRITIMVYVVSGALAGLAGLIVSADIKSADSIHAGNLIELDAILAVVIGGTALIGGRFSIVGTVIGALLIQTLTVTVVGIGVPDKATLLFKAVVVVALCLSQSPVFREKVFGRFKSRPAVRAEVPA

SEQ ID NO: 13800 - protein, 340 aa, Actinoplanes utahensis
MKTTIDATPEVAQNAPVNPRRRVYRPNAKYIPILATLVLLLAMYIGGLVNLEHFDDPRVVVNLFRDNAVLLVVAVGMTFVMLTGGIDLSVGAVISLTTTLTATLLKGGWPPLLVLPLVLVLGALLGAGMGAAIHYFKVEPFIATLAGLFFARGLALYINQESIPIRDKLWVTLSDLRIPLFDDVKTTLIAVVALAVVLIAAGVLAWTRFGRNVYAIGGSADSALLMGLPVARTRVLVYTISGFCAALGGVLYTINSTSGHALQGAGTELDAIAACVIGGVLLTGGSGYVLGTLLGVMVFGLISTIINFQGDLNSAWTRIVVGVLLFGFIVLQRLVTRRAR

SEQ ID NO: 13801 - protein, 494 aa, Actinoplanes utahensis
MSNGEIWFLTGSQGLYGPETLEQVASQSREIAAQLDAQLDADVVWQPVLTSAEQILDVCRRASSTPGVLGVITWMHTFSPAKMWIAGLDALRAPLLHLHTQHNVALPWSEIDMDFMNLNQAAHGDREFGFIEARLGVPRKTVAGHVSNPAVTARIATWVRAARGYSAMRSLKLARFGDNMRDVAVTEGDKVEAQLRFGVSVNTYGVNDLVAVVDQVTDAEIDKLVDEYADVYEIAAELKNERAESLRYGARIEAGLRQFLTEGGFQAFTTNFEDLGGLRQLPGLAVQRLMADGYGFGGEGDWKTSVLVHTLKAMVPGGATSFMEDYTYDLTPGNEVILGAHMLEVCPSIAAGKPKLEIHPLGIGGREDPVRLVFDAAPGKAIVLGLADLGERFRLVANEIEVVAPTEPLPKLPVARAVWKPAPSLSTSAECWLTAGGPHHTVLSASVGAEELADLADMVGTELLLIDEDTTTRQFTNQVRWNQAYHRLARGFGR

SEQ ID NO: 13802 - protein, 226 aa, Actinoplanes utahensis
MLLNGTDGETSEHKVIAPNPGLPNQALQVLALAQRTAEEHVASAQHHADKIRTDALAAAEQIARDAQSHAGTVRQEADRVLAEARAAAETMAREAQARAEEARRAADKIVTDARQRAEQIGADALHGAEQLKLQAQQRYDDVVGSLGAKREALQQQIEALENFDREYRGRLTQFMQGQLRALWADAPQVTAEVIEEEPIAEEIEAAPRRGHHAHQPEADAEADEDR

SEQ ID NO: 13803 - protein, 232 aa, Actinoplanes utahensis
MRRLATLLTATTLLAGTPTAAHAAAPVTLAYWPMNEPAGATRMSDSSGNGLDGQIGDEVGVDTAVNGATGYRFDRLEPDTPPPHPGHLVVVSSGGLLNPGVRDFAVTMRLRTVNHFGNIIQKGQSTTTGGNFKLQIPNGHVQCSFRGDRGVLEADAPDAINDGAWHVITCVRVSSGVALAIDGRRVAGRQGWTGAISNNWPLTIGGKLDCDQRAVGCDYFAGDLDYVTIETD

SEQ ID NO: 13804 - protein, 99 aa, Actinoplanes utahensis
MDRRSHRSGSTCRHVAARPAGRSCGRQRSRTDHHGVRGGADVVAFGDDGVWTAPGQRRRHLPLPRFVVDDLGFDAGGWRVDRHPRFVADLTGFGNDGPG

SEQ ID NO: 13805 - protein, 620 aa, Actinoplanes utahensis
MRNRLLPLALTALTLVAAGPPAPAGAARSPAEPVAGTWIGFGYNQDPQYAGGTGTPTPWDPRAFQRMTERTTFIRPPIVRVMLNRDWFNPTGVAGRYEWASVQMTNLYQVLTHYRSLGTRVQLGLWGVQPSSAVNPYTATETATVQADLMRRLYVTDAYTNIVRYTGVNEPNVKNEAKNYSYADWVTATTNLRAAFAAENLPVTLLGGPDTAEATISGQDGDLGLESVTGGAAATGQNAVWRADGLAGFDATFYVSPDTGAADWKFYTSRDGSSWAQLDPASLVQSAPVKTVATNPWYRYEVRNGAPLAAGTDYLRITLPAHAGTERALASLTMTTGAGGTVADPMNDWSHATSHSSGWTHLQGAPTDDWWLEAAGSSLVSGLQTHFYAHELDLADAGYPVQQLQEYPEATLREAVRQVRAAAPGVPVILGETGMKAPKSTDGKDYAFTDEPEHGVRMADLAVQEVRAGVDGAMAWCLDGYAAAVQCGMWDHEGTTEATTALRPWFYTWSLLCRYLPAGSTLYAPAQQPGLRLLQAQAPGSGGWTFVLVNRGTTAVTVPMTAPTGKVTFHRYLYQAAANPPGPVDADGFPVPAGTFLGSFDGGRPVTVPADAVVLITSMS

SEQ ID NO: 13806 - protein, 545 aa, Actinoplanes utahensis
MSADLVLTNGRVFTADPARGPATTVAVRAGRVVAVGADDVRELTGPATTTVDLAGRLLLPGFQDAHVHAVMGGVELGQCDLTGAPDLDACLRRIRDHADAHPELPWITGGGWAMEVFPGGVPDREPLDRVVPDRPVYLINRDHHGAWVNSRALALAGIDAATPDPADGRIDRRPGGAPAGGLQEGAMQLVARLLPAVTPAERLAGLLRAQTLLHSLGITAWQDAMLCATNGYPDVSDAYLAAATTGQLTATVVGALWWDRDRGAEQIPELLANRDRHTVGRLRCDSVKLMLDGVAENFTAAMTSPYRDSCGRTTANTGLSFIDPAALRSHVTELDAHGFQVHFHALGDRAVREALDAVEAARTANGFRDTRPHLAHLQVVHPDDIPRFRALGAAANLQPFWASHEPQMDDLTIPFLDPALAARQYPFGDLQRAGVHLACGSDWPVSTPDPLQGIHVAVNRVHHGAGHPPFLPDQRLDLATALTAYTAGAAFVNRLDDTGVIRAGARADLVVLDRDPFAGRPEEIGAASVAMTFIDGRLVHAAGRK

SEQ ID NO: 13807 - protein, 367 aa, Actinoplanes utahensis
MELPRWVETILRARRYGAAVLAALLALLVWDMPLDLGDFAGYGQRLLDGRLDGVYDSGWNQAGPLQLLISRALMIGGTHGMPARAVVIAVNVGLVLAAMTLCGRLTPDRGRRRAVRETATGLLVLLWMLVPVPWYGHPAELAVPGLWAYASLCQKRQRTVTAAALLGLAVAIAPWAVLGFPCLLAVSGPVRALRTWVLGGLAGIATYLPFVLAGHFAMFRHVWHVDNDTLVKILLPGMPDVTWEMRLIQAVLVAGGCAAVAWWCRGQRLAYAVAPATALLVRVFSDPVTLRYYWGPIAVATVLAFILVEQPRRQALALLLGYAAAFAALATRQVTGSAACLVLLVALVSVRPVARARPADTLLTPAV

SEQ ID NO: 13808 - protein, 197 aa, Actinoplanes utahensis
MPRPTKQQIDDEILDAAAGLFARHGFRETSVQRIADAVGYSKTGLLHRFPTKEALQAAVIERCVGQLREVAAGAAPLPTGPERDRMVITGVAQLARDQPGAVALLLSCLLAEPESEFGVALQTIGEQVAAAFGDEPFTGAALGGAGALADPVRSVRVIGALGALAVASVALRDCLTPDAVTTLVDVAYGALGHPSTL

SEQ ID NO: 13809 - protein, 717 aa, Actinoplanes utahensis
MATLLHRLGLGAARHRIVVTVAWLLALVAVAFGAVRLSGETVNTFRIPGQESTTALDLMKQRFGDASAGATVQVVFETPAGQKITDPVIVNQVTQSVTAFGKLPGVVAVSNPFDQQNPSVSRDLSTALTTVTYGVQPSEVTDDERSAITAALAQAKTGGLIVEARGEALSNAADIGGASEGIGVIVALIVLALSYGSLVAAGMNLLTAIVGVGIGVAGITTLSGFVQLQSTTPILAVMLGLAVGIDYALFIVTRFRHELRAGRDVESAAAYAVGTAGSAVVTAGLTVVIALAGLSVVGIPFLTEMGLAASATIVVAVLVAITLVPAILGFIGKRALPRRLRDLPPTTDHLAEGRGFIRGWANTVTRKRVTSLLLAVLALAVVALPFFKMQTTLAQRSPEGSTQAKADAIIDQRFGPGVSGPLLILIDGPQAVPYAATVQKQISTLPDVALATPPRPDPKQSAALITVIPGSGAEDQKTVDLVHRIRDEVADSAGAKVYVTGQTAISIDVSQKLNAALPVYLALVVGLAFVLLVLVFRSLLVPVVGVLGFLLTIGSAFGATVAVFQWGWLSGLVNAGSTGPIISLAPIIIVGILFGLAMDYQVFLVSRMHEAHAHGASPRDAIVTGFRQAAPVVLAAATIMFAVFAAFVPQGNDTVKPIAFALAVGIAFDAFIIRMIAVPAALALLGRSAWWLPRWLRWLPELDVEGAALERREQVPV

SEQ ID NO: 13810 - protein, 112 aa, Actinoplanes utahensis
MRCVDTTQLLKGVLDLAVLAVLRDEDGYGYDILRRLRAAGLQDVGDASVYGTLRRLFANGFLNAYVVPSDEGPHRKYYALNAAGRAELERNGKTWHGFAVIMDDLLRDRGTA

SEQ ID NO: 13811 - protein, 331 aa, Actinoplanes utahensis
MNDTATDQIATYVAAVRLALGGVPETTREELLDDLPEHLAEVLAEDNGTLVERLGAPAAYAAELLATAGFVSLPPQPDPRWDNLRETRDLVLRGLRVADVRVGPALGHERASEFLLLLRPAWWVLRGYLVAMVLAVVLDHGSGPIGLLPRIGGSDVVALALLAGCVVASIWFGRRPLPDKPWARYALWSGTTLLVLMALAGFTGFDSDLRQTPFVESGYSGGGPADAIQDIFVYDSQGHPIQDAQLYDSSGAPIQLGNATCTDPRTGNSYTSWHRGYPHCPDADPFQSPSPDPTLDGDNPHEEVTPSATPPSAGPSASGTPSAAPSASPSR

SEQ ID NO: 13812 - protein, 365 aa, Actinoplanes utahensis
MRRSIGAAIGAVLLMLALSPTPAHAASLTMLGADVSSLQRTLDLGGRYYTAAGAQADPYDILKGAGANYLRLRVWNNPAGGYNNKAKVLQQAKAIKAKGLKLLVDFHYSDTWADPGKQYPPVAWSSHSLSRLQTDVYDYTYDVCTALKSQGTTPDSVQIGNEINVGMLWPAGKVSNNNFAPVAGLLKQGYNATKACNSGTQVMIHTADADSDANARWFYDGIKAQGVSWDVTGLSYYCMWHGTLANLYNVIADVKSRYGKPVVIVETAYMYTTANADSETNSVPGTTTCDGQAASKTGQGTEFTWIQNTARNAGAIGVFYWEPTWYAIAGNGWDPANINGTGDGWDNMAAFDATGRWNSSVKWTA

SEQ ID NO: 13813 - protein, 352 aa, Actinoplanes utahensis
MKFAALLAAALLLPPTPPHAGLAMHGADVSTLPRAQDLGAKYYDRHGHRADPYEILQRSGVNYVRLRIWNNPTSGYNNRAEVVAQAREARRHGLKVLIDFHYSDTWADPGKQFIPAAWAGHDLEQLQKDVYDYTYDVCRATRPDSVQIGNEINTGLLWPAGQVDDSDFGPLASLLKAGYTAAKACDPRTRVLIHTADAGSIDAAHWFYDGIAAQGVRWDVTALSYYCMWHGDLTNLASVLNDLRDRYGRPTVIAETAYPFTTDNHDHLANIITSAAPCDGIPASPRGQAEQLRRVQDVVRKAGGLGVFYWEPTWTAVDGNGWDPEDIQHSGDAWENMATFDFHGRINPYIRF

SEQ ID NO: 13814 - protein, 343 aa, Actinoplanes utahensis
MIPNVSRKRPTIRDVAREAGVSYATVSRVLNGRDWVSPEAVRSVQDAIARTGYTTNQHARSLATGRSGSIAFLLTEPQHLLFEDPNFSVLLRGVAQALSDREQTLILMIASTQQERSRTLAFLNGGHVDGVLLVSPHSGDPLLRQLVQAQVPIVACGRVLGLEEMISSVSADDRAGARSATEHLIAAGRRRIATITGPMDTSGGVDRLAGYTDALLAHDLPIDSDLIVHGDWSRETGAAAMRILLSRAPDVDAVFAASDAIAAATLPVLRDAGRAVPGDVRVVGFDDSGLAATTEPPLSTVRQPLDRISEEMVRLLVDVINGRTPLSITVPTSLVLRASSPGS

SEQ ID NO: 13815 - protein, 275 aa, Actinoplanes utahensis
MKTGRIATTLLLLGAAYCLFPVIWVVIASSKSAGELFATFTLAPSTHLFDNLADLSDYRNGLYWRWMANTALYAGVGAGVSTFISAMSGYALAKFDFPGKGLVFNVILAGVLVPGVILAIPQYLLLAKVGLTNSYWAVLLPSFISPYGIYLARIFAAAAVPGEILEASRIDGAGDWRTFVRVVLPMMRTGLVTVFLFQFVAIWNNFMLPYIMLGNDKLYPLTVGLNGLLNQGASQPSMYTSVITGALVSIVPLIALFLTLQRYWQVDLAAGGVKA

SEQ ID NO: 13816 - protein, 307 aa, Actinoplanes utahensis
MSRTTSVNRTAGVPYAFLAPGLLLVTLFLAAPVAYTGYLSLRKVKVSGLGLGARSRTEVWAGLSNYARSMTDPDFLPSVYRILGYGLIVVPTMLGLALLMALLLDAGRTRPTIGAFARISIFLPYAVPAVVASVLWGFLYLPRVSPFSYALEQAGIHPPELLSSSWVLYAVANVAVWGGTGFNMIVLYTALRAVPTSLYESARIDGATEFAIAWRIKIPIVLPSLIMTFVFSLIATLQVFAEPITLKPLSNTISFTWTPLMKVYRDAFVRNDIYAAAATSVVIAVATFLLSFGFLKLVGRRAFNQED

SEQ ID NO: 13817 - protein, 436 aa, Actinoplanes utahensis
MKKTLAPLLATLTAAALLTIAACSSSDDKADDTTGTGKVALTYWSWAPNMDKVVAAWNSSHPDIQVTVNKQDGGDPAVTKLLTAIKAGSGAPDVMQAEYQKIPTLVSADALADIAKEVGGLKDRFPAATWNSVTLGSDAVYGVPQDSGPLMFFYRSDVFEKNGLTAPKTWDEYAADAQKIHKANAEQYIGTFSATDAGLFTGLAQQAGASWWGVNGQSWTVNVNDPATQKVAAYWGGLVEKGVVDNKPMYTPEWNAALNDGSQVGWVSAVWAPGVLEGSAKDTKGKWKAAPMPQWDAASPATGNWGGSATSVTSQSKHPKEAAQFVSWLNSDPAAIKLLATTANVYPAANDATAALTTPPAFFADQADFYTIAGEAAKQTRPFTYGPNVNVAYSAFNDAFGRAAESKKAAAFTASLATIQKATVDDMKNNGFTVAG

SEQ ID NO: 13818 - protein, 808 aa, Actinoplanes utahensis
MPEPTAPLSVRHQPWTTPLRRPRMSNDEDVRPGVSLTNRYLTRNGVPVVPVSGELHYSRVPRHRWAERLRQMKAGGVTVVASYLFWLHHSPAPGVYRFDGNLDVAAFVDLAAATGLDVVLRIGPWVHAESRNGGFPDWVQQAPVRHRTDDPDYLAMVTEWFDRIGGEIGTREILGIQIENELYTDPEHLRTLKRMARDAGLAAPIWTATAWDSAELPDEEVLPLYGGYGDGFWVDSDSPWAPNFRDHYFFSHVWDDPGIGADVRRAQNIEAAKGGPRTPSAEFPAATCELAGGMATAYHRRPLPTALDVATIAHCKIGNGSAWQGYYMYAGGTNPAGPDGMQESHATGYPNDLPRLGYDFHAPIGEAGVLAESHAELRRQHIFLTAFGHQLAEMPSSLPETRPDGVEDSSTLRWALRSDGTSGFVFLAWHQPYFPLDTYRGARFRVDLGERSVEFPSRPVDIPAGTLARWPVGLTVGGVRIDWATASALTVLPGTVPTLVLLAEAGIPAVVAVSDREHTPGAEPLRVETADGALDILVLPADTAASIWVTEAGGRRLLLSDDELQWDATGKIVVKTAAIAAVRRYDPAVRAFALLPVEPAPRPVSVAVATTEVRAATTVPASYGKHDGRASAPGRAAFDEHAAVHELHLPDWAADPEQDALLRIDWAGDAGELRLDGVPVTDRFWDGSAWQVNLVDAGYRAGARLTLHLLPLATVSSVALPSAARDRLVAAGSQLLAVDAIRVTGRRVTTERVDEHPVRRTSRRMADGREIIYFDDVSAGVTREAVDTRPLPPAEEVLRGGAQVRYDR

SEQ ID NO: 13819 - protein, 119 aa, Actinoplanes utahensis
MAAHRNDRTFMPPADRDPLAPTGPGGFPTEIAEADYDVVVFENRFPSFSPRNGGTADLVDGDPLWPVRPANGRTEVVCFSSAPKGSFGGLSPRRARTVLDAWISDTTPERTAARLRRIG

SEQ ID NO: 13820 - protein, 80 aa, Actinoplanes utahensis
MTDEDDLAFAAVRARVRAGECLALYRHGFSLASWLRRWVRGELSLPLLITDEETGVWRHETEADRATRPGGRPGAAGTAI

SEQ ID NO: 13821 - protein, 143 aa, Actinoplanes utahensis
MFDDNGSFLLATLEFFVFCAWFMCLFWVFGDLFRSRDLGGGAKTTWTVFLILLPIIGMLTYLIARGHDMSTRALEAQADARARQDAYIRTEAGSGTAGPTATEQITTAKELLDSGAIDRIEYEQLKAEALGTKAPSTTATGSH

SEQ ID NO: 13822 - protein, 281 aa, Actinoplanes utahensis
MTKQAPRSDHRAATGPGTPRMSEKEYQRELRHLHGELVAMQHWVKTTGAKICIVFEGRDTAGKGGTIKAITERVSSRVFRVVALPAPTDRERSQVYLQRYVPYLPGAGDVVIFDRSWYNRAGVERVMGFCTDEQARQFLQAVPAVERAIVDSGVILVKYWLEVSPREQTRRLKNRIDDPRKTWKLSSLDLDSYTRWDAYSRARDEMFRATDTPWAPWYVAGTDDKKRARLNILTHLLSLVPYEPMPPHAVKLPRRSEKNDDERSPVAVRHIPTPFGDPPRR

SEQ ID NO: 13823 - protein, 678 aa, Actinoplanes utahensis
MGVDRPIDVADPAAVHYDDEERPARELTGRVALAVAVVAAGAGVLTLWQVFRPLAQGSQFYLIVFLAVTLPLIFVAYRARAASPGRPSRLDWVLGGLALAACLYPLNPFGGGYDAFLDRQALLEPADVAFGAVLLITVLEAARRTTGFALPAVCAGFLAYGYYGGLLPQSWPIAHSGLDFAQIVDALYNSGSGFYGTPLDVAATYIVLFTLYGAVLDLSGASRFFVDLSVAAFRRSRSAAGRTAVAAGFLLGTVSGSGTATAVSVGAVTWPMLRRAGYPPEQAGGMLAAAGVGAILSPPTLGAAAFIVAEYLDVSYLTVLGWATIPTLLYYLGILLAVEIDVRRFGVRAVDLPQVGAGRLLIRFGYHFSSLIVIVVLLALGTSATRAVVYATLLAVALSFLDRPGRLTPRRLFQALAAGVRGVLPVVAVCAAAGVITAITTKTGLGAQLASLLVDGARSITGNPAAVLALTVVLAAVALAVLGLAVPVTASFIIGWVIIGPALLGLGVGAPAAAMFVFYYSVLSEVTPPTALAAVGAAAITGGRAMGTMWQALKYALPAFLAPIAFVLTGNGEHLLARGSWPGIVATAVASGFAVFGLAIATGGWVPGVGPAGPASRLLGGVAGLLLLYLSWLAVSAGLGVLAASVLLAAIARWRSRAEPAVPPDTEPRHSRRIGGNR

SEQ ID NO: 13824 - protein, 333 aa, Actinoplanes utahensis
MRRIMTAASIAALALAAGACGGRQHTAATDTGGDVTCQVARQTRIGIATGNATGVYFALGNAYAEQINAAGGRVQATAAETGASVQNIQQLVAGTYDVAFALADTAADAINGTAAFSAKQPIAALARIHTNYTQVIVRKAAGIRDVAGMRGKRVSTGSPKSGTEVIANRVLTAAGLDPARDVSAQKLDLTKTVDGMKEGTIDALFFSGGLPTPGITDLLTTARDQVEFLDITPVLPALQKINEVYRQGVIPAATYQQPADVTTIVVPNLLLVRAGLDPDVACVLTRTLFERQPQLAQANAAAREISLDTARRTSPVPLHRGAEKALDLLHAPR

SEQ ID NO: 13825 - protein, 165 aa, Actinoplanes utahensis
MSDRDEAFAEYFAARSGSLRATAYLLCGDWHRAEDLVSTTFTKLYLRWGRVNRQESLDPYVRQVLIRTFIDEGRWGWWRRERPHDTLTDRPVTPAVQTEDRLVLLRALAEVPPRQRAVLVLRYWQDLSVEETAAALGCSAGTVKSQAARGLATLRALIGAPVTAD

SEQ ID NO: 13826 - protein, 283 aa, Actinoplanes utahensis
MEENEFREALHSVLAQSPEPPPMRSAEAVAAGRRASRRRTVVACTGAVAALAAVTIVPARYLSAATSPTGYDAAAPAGTPSVLTTPPPSGVPSPQDTEPSWPAENNGDATADSGPRYQKGRQLLTDLLKVVPSGYTTPTGTTPDGSDLQSSQAALDDPEWTYLASVTVAQGGHNGELMVEVHEKNNRLPTDPCGLAESFWGLGGSCQVVRDGPAKVAVARSNGGGDNRIDQWAAYRYPDGVVVFVAQTGRPTYADARAAKLNPLPFTADELGKLALNPRFHLR

SEQ ID NO: 13827 - protein, 447 aa, Actinoplanes utahensis
MTAVTQPRIITFRRSIRVARVAIVAFLVLNVVVVQVMFAAAGPARNLPGTIGRLLGLHLALALALQLLLVARLPVVDRAYGMDRLTTWHRWTGLTIFWLALAHPAFVLLGFARLDRVPILDETVTLAGQLPVLLGMIAVGLLLVVVGLSIRAARRRLSYETWHFLHLLMYVVILLGVLHQLSEGTAFTVNAFTEAYWWGLWAFALGALLAGRLIVPLIRNARHRLRVAAVVDESADTVSVHITGRDLDRLDAHAGQFFLWRFPGHNPWWQANPFSLSAAPNSRSLRLTAKGVGATSAGLRDLPPGARVYAEGPYGAFTAAHRTRAATVLIAGGIGITPIRALLEDPELTGHIIVLYRVRTATDAVLLGELRNLTDTRHARLHLLAGRSGTGYRPFAPDRLKALIPDITARDVYVCGPDAMTTGVLDSLRRLRVPARQVHAERFRLAG

SEQ ID NO: 13828 - protein, 80 aa, Actinoplanes utahensis
MPITTEVYRRATETVTVMASIDDEGAEIRVIHERDGEVLTDTIPEWGDDPQAGRRWVARHREARLAEGYQLAEETEGPPR

SEQ ID NO: 13829 - protein, 179 aa, Actinoplanes utahensis
MTCIVGITDGRTVTIGGDSAGSDGWHVAVRSDSKVFQVGPYLMGFTTSYRMGQLLRYSLAVGEPDTWDVDRFMVTTFIEAVRECLSTGGYARTENGQEQGGQFLVGIHGRLYVVDADYQIGHTISGYAAVGSGYLVALGSLHSTAKSPISSRQRAEMALEAAADLTEGVRPPFTVVQSE

SEQ ID NO: 13830 - protein, 99 aa, Actinoplanes utahensis
MIPTMHVMTTLFTAGSPVPTVIGERDHAGSASTCRRIPAADGTRLLTVHPAQVRRQWSTGRLYEHLRPTLTLDRIMPADEADSWLTRVQPAREPDMFQV

SEQ ID NO: 13831 - protein, 264 aa, Actinoplanes utahensis
MSARLRAIAQETVGIAERGHYDGPDGRVEIAGQVARAVAGTRLHLPGEDLGEPSVDNPAPLIEITGESTLVAARRAGGVPAVLNFASARNPGGGFRNGAQAQEESLARGSALYPCLLAAGEFYDHHRAERSLLYTDRVIYAPAVPVFRDDKGRLLSAPYPVSFLVAAAPNRAAIRLNQPEHLPRVRPVLARRAARVLRVAAAHGHRDLVLGAWGCGVFGNDPAEVAAAFAEALRASPWFDRVIFAILDRDERVRDAFRRALPPR

SEQ ID NO: 13832 - protein, 562 aa, Actinoplanes utahensis
MAHAYRRHRSGPGRRGPGRCGAQQAPEVAESSDMKRFWADLSVNVKIMAAICVAAVIALVIGVTGLSSLNRASNTADEIYSDNVTSASVLGRIQTAINQARLDLVNHVIYTDAANKAKYEQEITTDFDDVATALKDYAATDPAGTPVIVASLNDTWQKYVDVAQSQLIPLSRANKVTQWQQVRADQVLPLVDTIKANLGDLNKAERADAESAAEGARTSYRQNRLQQIVILVVGIVAALLLGLMVARGIVRSLRQVTAVCEALAAGDLTRSTGITSADEPGRMSRALDAAVQRLRDAVSTIGESAVTLAGASEELSTVSSQLQSGAGDVAQQATSASSASDEVNVGVQSIAAGAEQMSASITEIASNAAEAARVANEGMSVAERTNQQVAELGAASAEIGDVVRLITSIAEQTNLLALNATIEAARAGELGKGFAVVAGEVKELSQQTAKATEEITARITAIQASSTSATAAIGEITEVIQRIGDYTTTIASAVEEQTATTGEMSRSVAEAAAGSGEVARTVTTVAEVAAATAEGARTTQQAAADLTRLAGDLTTLVGGFRH

SEQ ID NO: 13833 - protein, 169 aa, Actinoplanes utahensis
MRTDLYDRLADPARLIELARYDLGSDRLRAALDEVAQRSAKLLDAPASLVSVLGADAQQIIGEYGLGDWVAVAQGAAAEWAVCSRTVLKGEPYCVADFSDDPQYAANPFLATAGLRSYFGVPLVTPGGLMLGAHCVVDTRRRIYTGVDLAVLSDSADEAMEALLRHRRP

SEQ ID NO: 13834 - protein, 208 aa, Actinoplanes utahensis
MTTEDFPTAGDVRAVTRRAVAALRTVAAEDWHATTAGDLTWSCWETVEHVADDLFAYAGQLAADRPPVDRYVAWGWRRSRPDAPALTVHADPEQGTEGLLRVLEAAGGLLAAVVEVSPADRRGFHPFGVSDAAGFAAMGITEVLVHLHDIAATLKFDWTPDPGVSARVLARIFPDAPAGHEPWPALLWCTGRIELPGRSRRTAWRWHA

SEQ ID NO: 13835 - protein, 131 aa, Actinoplanes utahensis
MGEPATPIRRRIELSIAETRLRFQQLVRLTGLTGQVTVVVDGGRPIAAIVPAADVLRPPSPPDPPGRSGAGWLQRIEKVRDDVRRQHAGRIQELSQALDEAWQMLDQRHPPGTDRHVDALRAAQRDVRRTR

SEQ ID NO: 13836 - protein, 353 aa, Actinoplanes utahensis
MARQLDLFVPGMVFLDVIFTGLRELPGPGTEVRASGMGSCPGGVANLAVAASRLGLRTGLGTALSTDAYGEFCHQVLSRQEGIDLSASRRLDGWHSPVTVSLAYDRDRSMVTHEHPLPTDDEGLVNGLPPALAAAVSLGGPGTGWVPRAARNGTLIFADVGWDETDQWSFDALSVLPDCHAFLPNAVEAMRYTRTGTPAEALDKLAGLVPIVVVTDGSEGALAVDSATGEVATVPGVPVEALDPTGAGDVFTAGFITGTVGGWPLADRIAFANLVAALSVQHFGGSLSAPGWGDIADWWEVTRFAAQSRHPESSEGELARRYAFLPEVIPPGRRNAVHRATATIARLSDAHAG

SEQ ID NO: 13837 - protein, 289 aa, Actinoplanes utahensis
MPADRRDTLAGWAFLAPSLVGVGGFLLLPVLVVVGISLTRWDLVSPARWAALDNYSSILTDPAFGRSLAVTAVFVLLVIPLQTGLGLAAALLLDQRLPGSTVFRAILVLPWISAPLALGVVWRWLLDPSDGAVNQLLGHRVEWLTSPALALPAVAAVTVWTNVGYVALFFLAGLAGIPAQYAEAARIDGAGPWQAFRRITLPLLRPTMFFVLATGVINSFQVFDTVYAMTQGGPAGRTEVVAYAIYREAFVDFRMGRAAAMSVLLFLLLITVTVAQQSYFRRRTTYEVG

SEQ ID NO: 13838 - protein, 271 aa, Actinoplanes utahensis
MRRAVLTYLALAAGAVLILAPYLMSVQTSVKTARQFAQQPPLAPPDPPTGANYAELIVGGHTLIPPLVITVQVVLIVVIGQLTCSVLAAYAFARLDFPGRDALFWLYLATLMVPIVAVLVPRFVLLSQAGLTDTFWGIVLPSMFGSPYAIFLLRQFFRAVPQELLDAARIDGAGHPRVLRHVIVPLSRPILATLLIITVVTHWNDFLWPLVITSGVRWQVLTVAVAGLQSQYHGNWTLVTAATTLATMPLLLIFAIFQKHIVRSITITGMR

SEQ ID NO: 13839 - protein, 411 aa, Actinoplanes utahensis
MRRFLAFLMILALAGCSVADTGDSGSGRTTVTFRLWDDQVAEAYQQSFATFEKAHPTIHVDVQLVPWADYWTKLPADIAAGTAADIFWTNTSNFGLYADNRQLLPVDFTGDWTKSVVDLYTRGGTLWGVPQLWDSIALYYNKDLVAKAGVDPATLSWDPAAADDPLRAAARKLTAANAFGYNAAFDQQAILWDFVGSNGGTWQSGDTFDFADQPRTVQAVQYVVDLINKYHVAPSAADTNTNGDKTTQLFTQGKLALFQSGPYNLKAIQQGAGFPWGIAPLPQGPAGRVSVVHGVAAVASAKTPHRDATVEVLKWIGSADGQKPIAEGGYAFPGVTAAQPAFVDYWRKRGVDLKPFLDAAAGTTFPAPVGPRVGAGGTAYTPILQQIFLGQTGVTDGLRKAQDAGNAAMKG

SEQ ID NO: 13840 - protein, 436 aa, Actinoplanes utahensis
MRLVILGGGGFRVPLVYRALLADHRQTGITEVALHDVDPGRLHAIGRVLHALARDVPDAPTVHTTTDLDTALTGATFVFSAIRVGGLHGRVVDERVARAAGILGQETVGAGGIAYGLRSVPESLRIAERVAAVAPDAWVINFTNPAGLVTEAMSGILGDRVIGICDSPTGLVDRVLRVLDAPGARVDYAGLNHLGWLYGVYDAAGRDLLPGLLADEAGLATIEEGRLFPGLRELGAIPNEYLHYYYHPVAKADGPTRGEFLAEQQERCYREMSAGEPLEAWLRAWREREATYMADNRSQSGAGDRDHDESRPAGYEGVALAVMRALARDEPAELILGVRNRGVLDVLDADAVVEVPCRVDGTGAVPRRVGALPGHAVGLVQTVKAVERGVLEAVQTGSAAAAVRAMAGHPLVGDPELAGRLIAAYRAELPELAYLS

SEQ ID NO: 13841 - protein, 197 aa, Actinoplanes utahensis
MEQRWAELARTLRELGRWQHLSGDAAAEAERAVAAGGYPFGESGGDHDVRRFWLDSETMAEGGVGRVLREMAPALRTHGVDLRVEVVTVPLTGAGEGDYIVSINGRRCAAWTRADRAADCWWESATVRPLAVVNDLLAEAGARVRLFALYVGTEDALAWLVDPRIVAAVADSGLFRESDVPLLAAHDTVEQHFLKRG

SEQ ID NO: 13842 - protein, 211 aa, Actinoplanes utahensis
MNDGEDWHAWHTRYTDPGSPLSRRLRLVRHHIAAWLDERPGEPVSVLSMCAGQGDDILTVLASRPDAGRVTATLLEYDPRNVAAARSRVPAHATVSIVRADAGDLASYRDAAPADLVIMAGVLGNISDADTHRTILALPRLCAPDATVIWTRSRRAPDLTPAIRGWLTHAGFAEQSFTAPQDVLFSVGVHRFTGTPQPLTTGRIFQFVTHA

SEQ ID NO: 13843 - protein, 129 aa, Actinoplanes utahensis
MVSHVAAGAASVSGWTTLRRAAIGAGLALAASLVVAALGHPVISFWDVTLIVWSTGALHSNADHRHGRALTTAALSATVVWLGITALLDATGLPTTGAPANLARAVLGILAASQSYALITRTGQADCRP

SEQ ID NO: 13844 - protein, 452 aa, Actinoplanes utahensis
MDLQHRGARVGGGGCLATMALLIHVGHAARLSVAGQRAEVEWGDTGLAERGARLSVSVCPKAGAGMTASDVVRLLTGGEFDELERRFTAEMRAVVSAETVRVAWTVQTGGVPGEPGEPVGEPFTGDLTRWRVPVRHPAGDFVVVMSLDAGGRLHGLRLAADAGPAWQPPRYVRPERFTERAVGAHGALVTPSGRRVSTAAVVLPGGGEQDRDGTHGPDKPLKDLAWGLASRGIAVFRFDKPGPDRTLVEEYVTPAAQAVGEIRAAVPSVERIFLIGHSLGGKVAPRVAAAVPEIAGLVLLAAEAIPLQRSAERVTRHLAARDPGPAADAMLAAMQRQVALVDDGLTAQTPAADLPFGFPASYWLDLRGYDPVATAVALRRPMLILQGGRDHQVTVADDLARWRAGLGGRRDVRFRVLRRADHMFHSGSGRGPRHVDASVIRGIHRWSRLALG

SEQ ID NO: 13845 - protein, 111 aa, Actinoplanes utahensis
MPHVEVSAGTIVTILGLLVLVAQPGAIPFAYAVTTRHVRRGGTRPTLAAIVGYLLGCLFTLVCVATFACSDFPWLWAALLGYVPMWLFSVLILRQPEISPGPVVRTGPDGR

SEQ ID NO: 13846 - protein, 384 aa, Actinoplanes utahensis
MTTLQRREDNPIAHLTAEDIEAIGRELDAIRDEVLAARGESDAAHIRRVIKVQRSLEIGSRAVLLFSLFPPAWLVGTAGLSVAKILENMEIGHNILHGQYDFMRDPKIHSTTWEWDMATPAAQWQHSHNEVHHKYTNVVGKDNDLGYGIMRVDENQRWHPFYLAQPLWNFINALFFEYGIAAYDLELGSNLKTKKRRNNPEFRANVKAVGRKIRRQALKDYVLHPLLSGPSFLHTMAANFTANVVRNVWSHSVIMCGHFPNGVSTFERTSIKGETRGEWYLRQMLGSANISGGKLMHVMTGNLSHQIEHHLFPDLPSSRYAEVAVKVKALFEKYDLPYVTGPFPKQVASAWAKVIRLSLPNRKPMPAANPAIPPRFPAVEPATA

SEQ ID NO: 13847 - protein, 431 aa, Actinoplanes utahensis
MVIAAIVCTATSARPRRSGSTTAAGRRYDRTSRNGSITRLLRFKVLLLFPANNYGASDSLPPVMLSPVRAARLGQVAVTQTLRNGAWRVVELITTPVVPTDYLDVIAPLRNPNVLRGRIEAVRRETPNAVTLDLRPGRGWRPHEPGQYVRLGVDVDGIRLWRAYSVSSAAGHPSGRISVTINGVRDGVVSAYLMKNARRGMIVNLDLPAGDFVVPRQRPAKSLFVTAGSGITPVMGILRSLVHELSDAVVVHSARTGPDVVFGAELRALAAAGSITLIERHTATDGRIKPADLDALVPDLFERETWACGPGEMLDAMADHWAEAGAGERLHVERFRPTVLVAGDGGTVTFERSGAVVEAPAGVSILDAGEASGQLMPSGCRMGICYSCVLPMREGIVRDMRDGQITTAVEGDNVLIQTCISAAAGPCHLDA

SEQ ID NO: 13848 - protein, 413 aa, Actinoplanes utahensis
MFAGNKSRTLNRRSLVIEPLRDVRSYRLPAAVVDPLRRGLAEVAVQTIAAITMEVPAYAEAFAGELGHKIERAVQAALGTFLNLVSRPGTDPGTPLAAALEAAYALGRGEARSGRSLDALLSAYRVGARVAWRELAAISVRSGQPAGTIADFAELVFAYIDELSAASVAGHADELAASGRIRLRHLQLLAQALVAGEPSHVLQAAAERAEWTPPQTLTAVLLPERSSRSLIDLLDPRTLPLAGALPDLPGTAVLLVPDPQGASRPHLIRLLTGHNAVLGPARPWQRAQCSVERAVRVHQLHTPIGGAVVDTEEHLAELVVSADRGALADLRDRALAPLAGERGAAAAKLVETLRSWLLHHGRREDVATELFVHPQTVRYRMARLRELYGEKLKDPQWVLALTIALAVPPVAEA

SEQ ID NO: 13849 - protein, 603 aa, Actinoplanes utahensis
MGARAAPAAAVAAGRHGRRPGRRALGVRRAGRAAGRRRADRLRGPARATDPDQRVARPAAPRRDRAGPRRDRGDLSGQGHSDRARPRIPPGGPRYPARPARDARRHAPGVRIPLARHRPVRGCLPALDGRRRRAAPGRRGGARRPGGGPGTESRPGDRGTARQPGAARPRGTRRGRAAVLATAGAVVTRRQRLAAASGERVFDAIAIVVSAVGAVAIAAEAEAAGRIGGDATFYSLLLAVVASGALWWRRRHPVAVAALFVPVTVATDFAGVAAVIALYTLITRRRGWVIPLLFGLHLLAGTGYSLLRPDPHLPAAAEFAVTLAFLTATAAVAVAMRARRDLVDVLRERALRAEEEARMRAERLRALERERIAREMHDTLAHRISMVSLHAGALVIRPDLTAEEIARSAATIRESAHAALEDLREILGLLRAGPDDLRPQPDLAQVGELVAEARAAGVPARLDNGLAGGVAGSALGRTVYRVVQEGLTNAAKHAPGMPVHVTLGRTGDGMVHVTVTNPLDRPAGVHPVSRASGVHPVTRPAGVHPVSLPAPDEGREPPPGAGAGLIGLGERVDLLGGRFEHGVRREGDERLSFRMEAWLPWRM

SEQ ID NO: 13850 - protein, 215 aa, Actinoplanes utahensis
MADVIRVLIADDDRLVRMGLSLVLGADRQLEIVGEAADGVEAVEMTRRLRPDVVLMDIRMPRMDGLAATAEIRRYGPEPVVIVLTTFDTDDYLLGALREGANGFLLKGVAPEEILDGVRRAMAGESILAPSVVPRLIRHAVGGSGRPRRDRRLQRLSGRELEVAEAVATGRSNAEIGAELNMSVPTVKAYVSRLLEKLGCANRVQVAILVHESRR

SEQ ID NO: 13851 - protein, 60 aa, Actinoplanes utahensis
MDDEPMTAEEAELSRIERFGQLPPRVRAEDLVEMADTRSGFETPVTTMTEDERTLRYGAG

SEQ ID NO: 13852 - protein, 237 aa, Actinoplanes utahensis
MRTKIVLFAGAAAVALLAGGCGDKATPAAAPGAGAVASAASGVAAAPGGASAAPADAANSAPGVTPTKNTPVSTSQPKPGTTKDGQPGPAPAGDPGDGGNWFAALTPCPNKGQQHEVQKLVFADVTGDGVKDALVASTCQTTNAYWPSTVEVFDGTTGKKPKRLGVLLKDVGPTDEPWYVSSSVSGKVVTVKAYGLSAQAPRACPDLNLTYTYKYGNGTFTRTGRQAAKASGCLPIQ

SEQ ID NO: 13853 - protein, 411 aa, Actinoplanes utahensis
MRSRQSVQNLVRSACPVTAHRFTLALSGVAPGAEGKDIPMHIGVPKEVKNHEYRVAITPAGVVEAVRHGHEVVVQAGAGVGSAISDDDYVAAGARILPDADAVWGAADMILKVKEPIAEEYHRLRAGQVLFTYLHLAADPQGTKALLHSGTTAIAYETVQLADGSLPLLAPMSEVAGRLAPQVGAYSLMRNSGGRGVLPGGVPGVAPAKITVIGGGVSGANAATIALGLGAEVTVLDLSIPRLRQLDAQFGGRVRTLVSSTYAIEQSVLEADMVIGAVLVPGAKAPTLVGNDLVKRMKAGSVLVDIAIDQGGCFEDSRPTTHQDPVYQVHNSVFYCVANMPGAVPNTSTYALTNATLPYVLRLADLGWKDALRADPALALGLNAHDGVLTNDLVGKALGLDTESVSSVLAA

SEQ ID NO: 13854 - protein, 156 aa, Actinoplanes utahensis
MVTDLPKDVRGLDHIDLELLSLLRADGRMPNNALAERVGIAPSTCLTRIRRLREIGAIRGFHADVDPSWIGRPIQAMIAVRIRSDARDGIGKFAESLAGIPAVRDVYFISGNYDFLLHVAAADVDDLRSVITERLSGTRLIAGTETYLIFEHRRGG

SEQ ID NO: 13855 - protein, 262 aa, Actinoplanes utahensis
MTLSHLSHRELPLQIPAVAPGRSPIIGGTPEAAPSRPAEPSPKAAPSRPAEPSPKAAPARPAEPSPVTVPAWPAEPSPVVRGDWRERLALATDLAMIGVVATVLALPLITAPAALAAGSVAVRARYRDGRIPPWRSLTAAYRRGVLPGMTALPAVALLALDLAAVRGGRVPGGTPLFAVTTVAAIWLTGVGTLTLAMLGRALPWREAARQAWNRPWCASALAVINLVAVFLALTVPATIPLVIGFHLFAAHMLADRLAPPLV

SEQ ID NO: 13856 - protein, 277 aa, Actinoplanes utahensis
MTARLTRPVLLIVLTALVLYPLLWMLGSSFKAPSEILNNFSVWPREWTPANYPDGWTHFDVAFGRFFLNSFLVAALTVLANCASCLLAAYAFARLRFRLRGFWFALMIGTLLLPSHVLIVPQFVMFRAFGWVGGPWPYLPLIVPHLLAADAFFVFLMVQFMRGVPRELDDAAKIDGCTPYSVFRHVILPLSRPALVSTAIFSFIWTWNDFFRQLVYLSDLSKYTAPVALTLFIDSTGQSAVGPMFAMSVLSLAPVFLFFVAFQRLLVEGINTTGLKG

SEQ ID NO: 13857 - protein, 324 aa, Actinoplanes utahensis
MAVSTRPSRPRPQSGPAADQRRDRPARHRGEGRAGYLFLTPWLLGFAVITAIPMLMSLYLSFTNYDILSPFSEVTWVGWANYDRMFHHDPAYWHAVRVTLVFAFLATPLKLGAALGVALLLNRPFRGSGLFRGLFYLPSLLGGSVALAMVWHSLFDRGGSVNAVLGWFGIEGKAWVNDPHTALGTLILLAVWQFGAPMVIFLAGLKQVPAELYEAAEVDGAGTVRRFVSVTLPMLSPVIFFNLVLETIHGFQGFTSAFVLSNGTGGPVDSTLMYTLYLYIRGFANYEMGYASAMAWVFLLTIGLVTALLFRTGRFWVHYSDGDD

SEQ ID NO: 13858 - protein, 425 aa, Actinoplanes utahensis
MSALRLSRALMAAVLVLPLALAGCGGDDSSSAGKTQLTFFWWGGEGRAKLTQQALDLYTSRHPDITFKTTWQANQGYFDKLATLTAGDGAPDIFQIDDNYLAEYATRNVTLDLTSYKDSGKLDLSKFPESLWKYGVVDNKLAGMSMGENTQGLVYNKTRLEAAKQELPTTGMTWDQLIAWAQKAGAATKVPGTMDPSADYKAFWVWLRQNGKQFYNGNQLGFTSDDVQKWFELWKGARDAKATPTADVIHEGNATDITKQLVVTGKALTSWVWANQMPDIQKNTKDELGVVAYPGDPSAQWARASMYFSVYRGSKHRDAAVDVLNFLANDPEAGKILGTDRGLPSNLDIRRQVASSTTDPAMKASIALEDSLVSKFGPAPSVPPKGHATVKTELIKAAEAAQFGTASPAQAADQFFTAAQAAISR

SEQ ID NO: 13859 - protein, 667 aa, Actinoplanes utahensis
MADGRACARADVHHHRREPVDQAVHDDQGHLAARLDDLVVAHPGTAQQDPVDLLGQSPDEVGLDDRVLVGVGDEDVVVAPPGVGLGRLDHGWEERVGDVGHDQADVVGPPGDECPGGPVRAVAQLLRGGQHPGARLGVDQVRRREGARHRGDVHTGRLRDVPDGHGHDATSPKCDPALSGGAINANGCVRVNALRCRIALSRPCKGLVSRHKTPCIDSHRHLIANLMQTFAEGDVVIRYALVGAGARAGMFIRALTGDHADVARLVALADTNPARPQVYRRRHDLDVPVYPATGFTEMLQRERVDVVLVTTVDRYHERYLVAAMEAGCDAITEKPMTVDAASCRRILETSRRTGRSVRVTFNYRYNPLHEAVKRALPEIGEIGSVHFEWLLDVRHGADYFRRWHREKQNSGGLLVHKAGHHFDLVNWWLDDAPEQVFAAGRLFFYGEAGRRHGYARDYDRAHGAAAAEGDPFALRMADEPAMRELYLDAERHDGYLRDRNVFAPGVTIEDDMAVLVRYAGGASMSYHLTAYAPWEGYRVMVNGSRGRLELEVVETDHVAPAAAAGVKGEPGAVSTAERGWRRLLLRPFWAPPREITVDGYSRQGHGGADLRMLADLIRPDAPPDPLGRGATAVDGARALLTGLAANESLATGQAVRVSDLLDLEEIR

SEQ ID NO: 13860 - protein, 469 aa, Actinoplanes utahensis
MTLFPAEATQRGIARELYAHARDLPLISPHGHVDPALLAEDEPFGDPARLFVVPDHYVTRMLASQGIPPARLGVPSIDGSPVETDGRAVWRLLAENWHLFRGTPSRLWTEKVFAEVFGIGKRFSAATADEIYDQLSARLAEPDYRPRALFTRFNIEVLATTESPIDDLGVHAKLAADGWGGPGGRVITTFRPDNLVDMEWDGWADRVAALGALTGQDVGTYPGFLTALRARRELFVAAGATCSDHGHPTAATLDLDDAEAAVLYRKGLGGAADARDAEAFRAHMLVEFARMSIDDGLVMQLHPGSVRNHNQALYARHGRDVGGDIPSATEYVRALRPLLDRYGHDPRLRIVLYTLDETAFTRELAPLAGGYAALYLGAPWWFLDSPEGLRRFREAVTETAGFYNTAGFVDDTRAFCSIPARHDVARRVDAGFLARLVAEGRLPLDEAAETIADLAYHLPKRVYRLDRAA

SEQ ID NO: 13861 - protein, 484 aa, Actinoplanes utahensis
MTVTTTLGRAALPGLAPQARPLVTPGEVRPGILHLGLGAFHRAHQAIYTEAAVAAAGGDWGIVGVAPRSRDVLDKLRAQDRLYSVLTVGGDGGDRARAVGILSGLGHAAGDPYGVLAAIADPGIRIVSMTVTEKAYRLGPDGKLLLDDDLRAQLTGQAPPVSVPALLARALLSRSAPLTVLCCDNLQGNGPRIRGMVEQALEVAGAGLPDGVDFPATMVDRIVPATSAGHLRRAAVALGAADAAPVVAEPFHQWVIEDRFPGGRPDWAAAGAIMTGNVAPWETLKLRALNSVHSACAYLGALAGQEMISDALALPGMGGLLRRFLAEDIAPTFTPPPGIRVADYGETVLDRFANRELGHRTHQVAMDGTQKLPHRLLGTLADRRRAGAVPVWGALVLAGWMRFARGYADDGTALPLDDPLAGRIRAVVSAAPDTPAGLVDALLGVTEVFPAALAFDTALRAELIRWSGELARHGAAATIAAAGR

SEQ ID NO: 13862 - protein, 365 aa, Actinoplanes utahensis
MTARVALIGAGGHGLSHRRKLRELAGLGELEIAALCDRNPVDPEPAVPVFTDHGAMLAAVRPDAVIICTPPHTHLPIALDCLAAGVDLLLEKPPVTSLREHETLVTAVRESGRRCQVGFQALGSAALTRFRELTAASAGDLSAAGAWWRPDTYYRRAPWAGRQAAFDGALVNPFAHALMQALAVADGFEPVLLELERYRTRDIQTDDCTFLRLTDGDGRRIVAAVTLASPVFVAGEIRLGDIVLEYPTDRVLLGRTHHELWGRTGLLENLLSGEPLVAPLERTRAFTAVAEAIVAAPLPATVPAGELRPHPDGDGNVLPGADELVRQVAATGLLPSETDVSWAAPPHRVTLETRKGTTDAQTERR

SEQ ID NO: 13863 - protein, 111 aa, Actinoplanes utahensis
MRKLSVAELEAHHRGATFTSVLPGHVVQKGGFRVYAEPNFRTHDEPGRHVHTVPEIFVIVQGSGVMEVDGAEAGEFRAGDAVIFEPGEDHHLISRGPDPLVFVWMHLEPVS

SEQ ID NO: 13864 - protein, 447 aa, Actinoplanes utahensis
MSRRSALAATIGLVLAGVATVPAAASASAATIPGSAVPGSAVPGVAVPAAARQVLPVNDGWANGATGGSAAAADHVHVVRTRDELAAALAPADTAPRIVLITGTLRPDGDCAAYTDPAYSLDGYLGAYDPAVWGRTSKPSGPLEEARARSAKNQAADVQLKVPSNTTILGLANARLVGLNLLISAADNVIVRNLRLEDAADCFPQWDPTDGATGNWNSAYDLITLVGGTHVWADHNTFSDGDDVDANQPLYFGRPYQVHDGALDVIKASDLVTISYNVFQEHDKTMLIGSTNTVGADVGKLRVTLHHNRFANIGQRAPRVRFGQVDVYDNYYYATDEDFYQYSWGAGVYSAIYAENNFLLRSADIPLDAVVHNWGGTAMTEKGTLTRIGTGKVTPVSLLAEYNATHDPDLGTDAGWTPTLRPGPLTPTAQVPAVVTAQSGAGRINLS

SEQ ID NO: 13865 - protein, 186 aa, Actinoplanes utahensis
MRAVVELGSDRWLELDGRCGAEQAALFVGALAGADADLPAAERIAALLAAEMLIVAGGLALDDTVSGVSIRPGCCAGLEDWRDWASIAAGQPVWLGHSPEPRIEVDGDRRRVWQDVTPGSPHVDVTGAELFRLLAGVQRDLVGFLGVLRAWGRSFGRGDLLAARIDRDFAITAPLPDAGWVDQAIS

SEQ ID NO: 13866 - protein, 235 aa, Actinoplanes utahensis
MNLPAEVRALVRTRFAEPRANALLALSRPSIGYEPSDEGWSAFGGEPRLAAFDWPMHRGTPMLLLAALDGDEAATLLGPAWPFPDDGSLLFFHDEDFTAGWSPHGDTACRVLHVPADPVAPLPRIRRTIEPTPLTPAPQATLPAPEDLADHLDVDLDELLHLAEDLRPHLPVPRHRLLGHPDHLGPQPPDHRPLLQLRPEAGTVWGEVVSVTFWITDADLATGTLTHVRRTYEMA

SEQ ID NO: 13867 - protein, 389 aa, Actinoplanes utahensis
MKRYRSNAAGSNARRWRVAGIAGVAVVLAGVGLGVANAATSEAVPTVNCPQVAPRLPAVPAAAKAEVERNLALLNTQIQEANKRLATSVGQGGPNFIQNAILGPLKDKRASTIDRIAISIGRRAAKPNLPVNQLATCALNKNGGGNAAPEPTTVAADNGAAAGNNGAAAGVPTVNCPTVGDKLPAVPASAKAEIERNLALLNTQIQEANKRLASTVGQGGKNFIQNAILGPLKDKRFATINRMETAIGRAAAKPDLNAEGLSGCTLNQNGGGNPAPEQTAVQAQDPAVAAANAPTVNCPDVKIGVAIPASAQAEIDRNLALLQTQIQEANKRLASTIGQGGPNFIQNAILGPLKDKRFSTINRMETAIGRQAAKPNLNAEGLSTCSLNK

SEQ ID NO: 13868 - protein, 222 aa, Actinoplanes utahensis
MLRRIAPPEETHVPPSLPRPVRVGSLSYAVAAVAAALVGVMAVACWWRVGATADSFLALPLPPRDVAAVPAKAASLRLALGGSAVAAILIAGAAGLLAAGIQRPAVAWIRTAGLWVSFLGGAALIAGVLLVPVDRSEGTTVVIDLAAVAHTDLGSGPLPLADWYPTVFVPLGWLAFAALVAAGFQLSRTSMADYSRPASHLEDERWTSFVQRQQERQQLPGE

SEQ ID NO: 13869 - protein, 300 aa, Actinoplanes utahensis
MIVRALPGTAVPPRRPGHSRWRGFLSRIRVAREERTLSRGPPDDHPSPAGWASAHRPGRIGRVRVFLAEGVRETCVALRAPAATVPCDHLEMGSLVLLRPRPGVYGQLRLAFEPPRSASWRMLGRSPGEYRFVVHQGDRAALHRSIEAAVRTLRRWPILSGHVGLADPSPRLARTLWDLSGLLIERDRVRRTRDRLTDVDPAVPPDTPLRAELADRAAQARLRLRHLGVQARDQLTHLTRLAAETDAFVRHEQASAAARAALRASDYLLSPAAPAPPDDEALDLADHTSAVLRAYRELTA

SEQ ID NO: 13870 - protein, 424 aa, Actinoplanes utahensis
MSAALVSPGPVRPVQPVQFTPPAPVAAPAAAPVAAAPVAASLAAPVAGPVAAPVVAEGPVRPTVAQIAALVTATSEAPVAGSLGQRLAAAVTPEEMLGMPAPAPEATADVPAPRRPAEQTAVPGAVPAVPGPISAPRPFLATSPVQATNGGANGTNGAGNGNGNGNGTGSGSGSAAQGAAPQTPAWAATPTGAQRAVNIVGSPWWRLAVERMARIVRSEITPDNLSEMTYSRMAELVKSIAPRVSGLGEGVVKSFVNDYVREMNGEPGEAAYPWRDLLPDPVTLPVGSELWMQEIEDLRTALVEELESSDETDPRELAMMLAPSVPRLDDETIRAFVSDYVAALGGQPVGVDQPWEHLLPRPQGGRGPSDEEIVEQFGGLLHEHLRTNGRLSRYRVTAVTGVKGARADRIKGIIEDQAAESAPA

SEQ ID NO: 13871 - protein, 143 aa, Actinoplanes utahensis
MTDVDRTRPAPAAGRAVVWVQLTLLTAYLIGSFGILILAAVRVGDAGALLHPGLDRLGDPEDSLPGAGNPLVGVLGVCRLVAWFVYPLGIAMISFGVVTLVHSWRRDERRRAGWLAALTASWLVLVLVAASPYGGDLITWLLH

SEQ ID NO: 13872 - protein, 337 aa, Actinoplanes utahensis
MAVTLADVARLAGVSPATVSRVINDSAKKVAPELRERVLAAVAELHYVPNAHAQSVARPRKSAVGVIVHDVSDPYFAEITRGLQRQAAAHDRLLVICNSYREPERELAYVALLRAQQVHALILAGSGYHDDAFTARLNGELNAYQQGGGRVAVIGRHELVGSAVLPANESGAYELGCRLLTLGHRRIGVIAGPRSLTTTTDRLSGIRRALAEAGTALPPERIVYADFTRDGGAEAAGRLLGAAPDLTAIVALNDSMAVGTLATLREHGIAVPARVSVAGFDDMPIARDVTPALTTVRLPLVGMGERAMALALADDTAGVSEPAAATLIWRESCAAPA

SEQ ID NO: 13873 - protein, 361 aa, Actinoplanes utahensis
MSTAGTSLAESLRKVTRGPLPTGSARRQADGMTTRVGINGFGRIGRNVFRAAANSDVEIVAINDLTGSGTLAHLLRYDSSLGRYPGTVEAHEDHLLIDGHRVEVTAVRNPAELPWKDLGVDVALESTGRFTAAADARAHLAAGARKVLVSAPSPGADLTVAYGLNHGDYDPAAHDVVSNASCTTNGLAPIASVLDDLAGIETGSMTTIHAYTQEQNLQDGPHRDLRRARAAALNIAPTTTGAATAIGLVLPRLAGRLTGYSVRVPVPVGSLVELNAVVERPVTATEINSAFEAAASGPLRGVLAYSADPLVSTDITGNPASSLFDSLLTAANGRLVKVVAWYDNEWGFANRVVDTLTLLGR

SEQ ID NO: 13874 - protein, 325 aa, Actinoplanes utahensis
MFLMPGAAPLDVGIPAQVFAPRHGLDYRAVPCAVEAGPVRGRDGLGFFVDAGLEALDDADTVIVPGFLNPAGPIDPRVLAALRTAAFRGARMVSICTGAFALAAAGLLDGLRATTHWLMAPTLAREYPKVTVDGRVLFVDEGQILTSAGVAAGIDVCLHLVRRDHGVQASNAIARVLVAAPYRSGGQSQYVPRSIPEPLGDVFAATREWALAHLGEPLTVTGLARHAGVSERTFGRRFVEDTGYTPMQWVLRARVDLAREMLERTDLGIEQIAARVGVGTGANLRMHFQRILSTSPSEYRRNFAGGKLAQGDARPPADRLGTAAG

SEQ ID NO: 13875 - protein, 336 aa, Actinoplanes utahensis
MRDHSNRSAGRPTLEEVAVRAGVGRGTVSRVVNGSAQVSPKARKAVQDAIDEMGYVPNRAARALVTQRTDSIALVVFESGERFFAEPFFGRIVQSVSSVLVARNLQMVLMIAQAPEERRQLEGYLTRQHVDGALLLSLHGDDPLPAVLEERGVPTVRVGRPVHPGPVTSVDADNRGGARAAVSYLREQGRRCIATITGPMDMAPGIARYQGYRDVVGDGPAAAGDFGEISGAMAMEWLLANHPQLDAVFAASDMMAAGALRVLRRAGRRVPEDVAVVGFDDSVVARHTDPPLTSVYQPVEQMGQEMVRLLLAKLDGDEPVEHETIMPTRLILRGSA

SEQ ID NO: 13876 - protein, 350 aa, Actinoplanes utahensis
MAGRRRGGRRGRRSAGRRARRRGGAPRHQAGQRDALQRWREAARLRDQRGRRGAGRRRHRGHLRHPGVRGAGAPGRQAGRAGHRPVRAGRAAVRDGGRGAAVQCGHLGGAGGGPADRAHAAAGRAARPADRSDPPLSGRRPGVPPVGRRGVEGAGRAGSGGEQEDADGAAARRPPAGAARVPALNPPPVRATRGRKIAVGAALGATAIAFLALVHVVSQSGDDLAQPPPAAPVAPSVPATSAASSPSPRPATTPPTVAKRAAPTLTVDVALQRVEAAVDRGERTGEIRGDVAQDFRNLLGQLATQDNPDIRGQVDLLRKKVRQRLGEGGLSAGQAALLQDRLADLGRAGA

SEQ ID NO: 13877 - protein, 216 aa, Actinoplanes utahensis
MRMRRIAVAVAMAAAVTAPAVVTDVAAFAKSPAVSKHGDDRNDNKGNGNAGNKGGDNSNKGGDKARSKKVAFAAEGTVTAADAASVTVAVKGGTKDVRGRTVTFAVTSATRIRLNGKRVAATALAAGAKLEVSGTRVDTVYTAVQIEATLRSGRPKPAPSPSGSATPTPSPTATPSPSGSASPSPSVSPSPSGSATPSPSDSPSPTDTPDPTDSPS

SEQ ID NO: 13878 - protein, 611 aa, Actinoplanes utahensis
MRDRVLVPITLLSLLVLTPYVVGLGTDRERLILCWIVAPLTDLGMAALSRQASRLPGSPAANARFWRAMAAAGLLFAVGDTVQLASVLATPGGSVFRLHPVQSLLGVLGVILMCVAGLRHPGHLWSRGTRIRVALDAAIVYSAAGVAVWCLLTRPGVAQAGAMGYAAATFGCGVLLIGGFLAVKLGLGGSSPIALPAAITIVAGAAVQAVGNALLPSGSIQGVTVPALLILFPCLLTLHTPRLHTLAVRARQRAPERRSGTRRRYSSLPYLGTVLCVAILLVVLLVEGLGVSAWGALIGLLLNVTLVVARQMLALAENNTLLDQLDESLAEIRRRERRQDALLRHASDITAILGTEGVVRYLNPAVERIIGGSVDDYLGRSLFDLIHPGDAARIREEMTGVFAVPGAKGTFELRAQHEDDSWRWLSVVAVNLIEERGIGGVVINARDMTEERELRERLRFQAGHDALTGLANRRQFTGRIAACGASEVAVLLVDLNGFKQINDTHGHATGDAVLRHVADRLLDCCGPGDLPARLGGDEFAVLAAAGAPGAHRIADRLRAALTAPAEIGDQRLSVGASIGVAAGPADQPDNLLHLADLRMYADKQRSREFAS

SEQ ID NO: 13879 - protein, 763 aa, Actinoplanes utahensis
MTRAWRPAALTGAVALLGTLWYVWWCLAPAGTFAVAYVFMPVGSALTVAAVRSLRRSTAMPPAGRRFWLLLEGGAALMTVGYTILAVAAFRAAPRFAAMPLSAAITVGLGLLAAIAAVAVVPLGITSWYERGKQWLDRSIAFLGCAAVLWHFGVAPMLSGAIRWSSSVLAVVLLAFVFAAGAITKVSYVPGGPVDRLAIRLVAGTGLVTAAFAILAVARPVDGSIPAQAVLLPLVPVLITLAVGRQRTAPPSRPARSGTWLPYLAMLAADVPLAHVLFGGATVGEAIHEGRIVVSGTALITTLVSVRQWVVNRDNARLLRDREASDARMKYEATHDSLTGLGNRVLFRQRLETALAADGATVLLVDLDDFNTVNDSLGHDVGDELLIAFAETLRAATGADGEPARLAGDEFAVLVTAPGQDQAVVERIMTAIAAPISAHRLLVHASAGIAAAPPGAPAGQVLRDADAAMHTAKQRGKANWVRYAAGMEKPAQAAAQLGGDLRRALDAGEFKLVYQPVVDLRTGRTVGVEALVRWAHPERGMVSPADFIPAAERTGLIVPLGRWVLRETCRQTAAWLAEFGPDALDKAAPNVSVRQVHDPDFVADVRAALADTGLPAARLVLELTESAVLRGHQVLKVLHELHDMGVRLALDDFGTGESSLSLLRTFPAAIVKLDKSFVDHIELDEPDSPAANARQAVARAVVQLADALGLDTVAEGIENQEQADRLARLGYSMGQGYHLGRPVAPEEITARLAAEQVSLRTAA

SEQ ID NO: 13880 - protein, 182 aa, Actinoplanes utahensis
MQRSAPVTPVEFPGMDTADDGTFTAHALTAWLERLSFTDLPEAEATARIIDAVVAWGAAQRWRVYRRAPSVVPMPPPLHGNSVLDVACARPGGAAPIAIEVDRLDRQRTVDKLLAEAAAGRVAIWVRWGTGPFPPPPLPVHLVIREATRRSGRWHTVSGRPAPNHSGAAPVVAEAEELPWEL

SEQ ID NO: 13881 - protein, 334 aa, Actinoplanes utahensis
MGTVTESPSRLAWRVTEPLHALVYFVPEAAAAYRRLGLDPMGGYFALRAAALGAAGPELVAATFYNFNPSVIGKVLPAAWDVASPQQMVETRLAIADAALTRGLGAETLAGPEIAEAADLARTAARHASTMPHGRPLFAAHAGLPWPTAPHLVLFHAQMLLREFRGDGHLAALLSAGISGLESVVLHVASGEIEERFLRGTRGWKREQWAAAADALRARGLLSPSAAPAAAAPDPASTPGAVAPSASASKAVSASAFAAASAAAAAGTGERTRDELSEAGRALRAEIEATTDRLAEPAYRILGDDGCRRLAELTRPLSRTLVKSGFLNPVALLG

SEQ ID NO: 13882 - protein, 257 aa, Actinoplanes utahensis
MIRQQRHPASWWDQFQQASDKFDLAILTESLGDEIAPKISSPLLRREAEIALEVMVRHLNKPASEELAERATKGVQRLVETVARLQERSGDGFELREAQALIHLLEGKTGDAASEAEEFLKSQVILRAFVAALRLERFDSTLAVKLLAAGHDPAAALHSGQVIGKYAWWPSWLLKVVTERAMAGTLDEDTVAALDRCAYAELSPAQARMARRLLDGEEALIDASSVRLEALGEVDSAEKLRKGDLTMVALAARLIPI

SEQ ID NO: 13883 - protein, 446 aa, Actinoplanes utahensis
MILALVVVTALAFDFTNGFHDTANAMATSIATKALRPKTAVALSGVLNLIGAFLSVEVALTVTNAVVKIQDKSGAPKAALLAHGGTTLLLIILAGLVGGIVWNLLTWLVGLPSSSSHALFGGLIGATVAGLGWAGVNWNGDGSKLDGVVGKVLLPAVLSPVIAAVVAAAGTWLIFKITGGIAARFTEKGFKWGQIGSASLVSLAHGTNDAQKTMGVITLALIASGDWHDTKNIPLWVKVACALAIALGTYLGGWRIIRTLGKGLTDINPPQGTAAQSGAAAVILASSQLGFALSTTHVATGSVLGSGLGRPGGAVRWAVAGRMVAAWLITLPAAAVIGAAMWWIGHLIGGVPGAVVVFLLLVAASVAMWLRSRAHHVSSENVNDDWDTSSPAAPADAAVVLAADPEAPAILLGADPASDVKVPDSPASLTSPATAATDPGRVASKN

SEQ ID NO: 13884 - protein, 102 aa, Actinoplanes utahensis
MHNLGFALDGAWRVLLAGLVLGAGLPVLFALGIRSLAWGAGEASVGPSGVTAGAKHPLGTVLGYLLFAVVIAGVLLGLTFIVATGFGDKLSFEHIYPTIVPK

SEQ ID NO: 13885 - protein, 373 aa, Actinoplanes utahensis
MADRRQVLRFGAVAAAAPALGGAVASPAFAGAQQHTGAGHRPSKHTTSLVVGHRGASGYRPEHTLASYELAARLGADYLEPDLVSTKDGVLVCRHEPEIGGTTNVASHPEFADRKRTIVLDGVSVTGWWTQDFTLAELKTLRAVERLPGVRQHNTLFDSRFEVPTFQELLDLRKRLSRELGRDLGVIPETKHPTFFRNLGLELETPLVKILRRNGLDRRGARVWIQSFESKNLHALADRHRVEVPLIFLTSASGTPFNDSRTYADYLSPAGLEELSEYVDGVGPDKSQIIPRNADGTLAAPTSLVKDAHHAGLQVIPYTFRAENQFLPAELRVGTDPNAYGRAIDEQITFLRTGIDGLFTDQADIGVLARSLA

SEQ ID NO: 13886 - protein, 378 aa, Actinoplanes utahensis
MPVPLRSLLGEPSPPGAPPLSWRDGLLVAVCMAAAVLEGVFRPDLPHRMVAVALAAGLAPALLIRRSRPLLAVTAMVTATLLAPLLTDGAPPEEYSLAYLLLLPYALFRWGSGRQIAIGLGVIVGKQALAYAFGQVDVGDTIGGTVLAGAILALGAAVRYRTGARAREREQVRLRERERLARDLHDTVAHHVSAMAIRAQAGLATSAAHPDAAADALRLIETEAKEALAEMRTVIRALRTDEPDAPRLADLIGLATGAGPRVDIEVGADLGAVAPAIGAAIYRIAQEAITNARRHARGATRITVRVAADATQVRLRVEDDGAAPGPLRSGTMAGYGVSGMRERAELLGGTCTAGPAADRGWCVEAVLPRPILPGAVTR

SEQ ID NO: 13887 - protein, 216 aa, Actinoplanes utahensis
MTVRVLVADDQEIVRTGLTLILNAQPDIQVIAEAANGYHAVELARRLRPDVCLLDIRMPGVDGITATRELAGPGVADPLAVVVITTFDLDEHVYGALRAGARGFLLKEAGPELLGQAVRAAAAGDAIIAPAVTARLLGEFARGPHRGASRQPAEPLTEREEQVLAAVAGGRTNNEIAADLHISLSTVKTHVASLMTKLGARNRVEIAMWAYETGRR

SEQ ID NO: 13888 - protein, 255 aa, Actinoplanes utahensis
MTTAAGIDRAPDDDRMRAGGDVPAGRAGKDAAKEGRGARRPQRRRRGGWRIPAGLIALSLVPSIAGAHRLGELATSAPVTEENARFFAMPLPVVAHIIGAIVYSVLGAFQFAPAFRRRHPGWHRIAGRVLVGAGVIVAVSGLWMAVFYDLPPIDGPVLELTRLVVGTGMLAALVLAVVTIRRRDIAAHRAWMIRAYALAMGAGTQVFTHLPYELIAGTPGVGTRAFLMGAGWGINIIVAEWIIRGRPGPRARRPA

SEQ ID NO: 13889 - protein, 1002 aa, Actinoplanes utahensis
MRGAGTPRLRRMLTMQEALARLTAYWTEQGCLIVQPMNTEVGAGTLNPATFLRVLGPEPWRVVYVEPSVRPDDSRYGENPNRLQTHTQLQVILKPDPGNPQELYLGSLAALGIDVAAHDVRFVEDNWASPALGAWGLGWEVWLDGLEITQFTYFQQAGGLNLDPVSVEITYGIERIIMALQDKQHFKEIEYAPGVSYGEVFGQAEYEMSRYYLDDADIDANRRLLELYAGEAQRMIDAGLPVPAHSYVLKCSQAFNVLDSRGAVSTAERAAEFGRMRRLAGEVAKLWVARRAEQEHPLGTTGEPAAARAAGSTQTGDTPRTLLFEIGTEELPPAELRNAREQLLRLVTEGLAGTRLGHGEIRVFGTPRRLIAVVQAVAAREDDHVRTVKGPKTQAAYAADGTTPTKALDGFLRGQGATLAELETAEFNGVPHVVVRKPEAGGAAPQVLAAVLAKVVGGLRAAKNMRWNDPKLAFSRPLRWLTALWGDDVVPVAVSTLAAGRQTRLLRTAVPPVAEIASAETFLETLGVNGIVADHEDRRELIVVGAQDLVYPDGKVDVAGEAALIDQITDLVEQPLPLLGTFDEGYLTLPDAVLTTVMRKHQRYLPVRDEDGRLLPMFVTVANGPVDVELVRSGNEAVLRARYEDARFFYRADLDTPLAELKARLDRLTFTDKLGSMADRAGRIGALAKQLAERLDLGSPTLDRAAELVKFDLGSQLVTEMTSLAGVMARDYALHAGESRPVAEAVFEAELPRNTGDALPRTLPGALLSLADRLDLVAGLAATVGLPTGSSDPFAVRRAVLGLLAVHRATPEFADLSLVDALTLAAAAQPVPVAAEVLPAVADFLAKRLEQALTEEGRPVDRIRAVLPHFARPSVADTLLAQLAPAVADPDFAAVAAAIQRARRIVPDGTTARYDAGALKEPAELALHDAVTAVRAALGPDAGTDLPRFVAATGRLVTPVNTFFDDVLVMADDPAIRAARLGLLATVRDLGDGLLDWPQLRL

SEQ ID NO: 13890 - protein, 218 aa, Actinoplanes utahensis
MAIEALIFDFDGLLMDTETTLLDSWRWEWRQHGLRLDESGFFADHGGDTSEIRYAALAAAVGPGFDRSASHARRTAYRERAHAALGLATGISAWLAEAERRGLRLAVASSSAGAWVRTNLARTGDLPRFEVLACGDEVPADKPDPAVYHLALHRLGLTADRAVAFEDSPHGVTAARAAGLRCVAIPNPHTPHARYRHADTLLPSAATTILSEVLARLA

SEQ ID NO: 13891 - protein, 714 aa, Actinoplanes utahensis
MVQVGGVQQDHRVVTAGQGAAQTLVLGQDHGRVAGGGGQFGGELAGQGQRGQVVAAGEVELGAGVGGGRPGLRAGAETGVRLGGGGQRRGRAVTIERGQDDGGDRGRGEQGDGGGGHGWVAHVHGALRVSGARDFSTLTAQSIDFQGIPPVQPDGSAAHGAGPAGTVGRGGPGGMPRRAGYRIATQLRPGGGRRRLKPGAVVPTSGTMSVGSGLHTAGPLVEAPGGTGAEPDRQVLLLAELVGFMTKDTPSVQHVLDLMTPHLCEVAGLTAATVFELDSESGLMAATAQFGEPGRRDQMVAGKVFRAAAGGPPVVSGQQMAIRLRIGGQTVGVLLLTGERLAELRPDTISTIALHFATTLQGLFAEKARQFVAHTSTTIQELFEKGMTAGSVEEAAELLTHSCATAFRTEHAGLHLIDSDGRIRYVYGVGCPDERLEQLRLNLVGKSAIESPVWRSTVESGEPVLINNASTAKVRPGGMTETLGLGSFIAMPLMTGFGAVGMVLCGDSSGAREWSGRDRILAQQLSAEGALIMDSARMRQANRLHVEELTRQAFHDSLTGLPNRKHLLDRGDEAIEIAMCTGTRLALLLLDLNGFKQVNDTIGHHAGDVLLQLVAKRLDGLIRKPDLVARLGGDEFSVLVTGNPDDQAAVRVGERICERLREPFEIDGKPVQIGASIGVALFPRHATNIGDLMKDADASMYLAKRSGGGVHLTA

SEQ ID NO: 13892 - protein, 439 aa, Actinoplanes utahensis
MRSRRRRGRPARRRTAHAGGPDRGPGTAPCRTGGRRPLPLVRRGLPGSRRGPRHHRDRGPQPGEPGALPPHPFPLPRAAVRLSRSAACLARFSRSAACLARLSRSAACLARLSRSAACLARLSRSAACLCRRAARLACRDADRKPSDAYGGTPMTTDLDLPAERDLPPAHAARIRATLLHTPEKRDRRALRLAIAASLTIAVASAIAFVRPQPLPTTIALGPGELSSTLEAVVDHCVAQRAEIVERLPEPADLPAVSSADVAVAAETHGQATVLFVNERGFAACSAAQIARPVFGVRIEADGGFTGGPWDGRRDWLPGPVEVLMSGSSDRGGPAQLDVVGRVSSRVARLVAVDGPHQVPASLANGAFGLLGTGDVLGPGTRLIAYDAAGEPIHEEPLFPATADRVTRCWADPTGRVLYQPSDQPPGKPGNCLPAEPWGF

SEQ ID NO: 13893 - protein, 591 aa, Actinoplanes utahensis
MRPISTRARALTAAAAVSVVAGAGAVAIASEASAAAGCRVDYSVNQWSTGFTGNVTVTNLGDPISGGWNLTWDFPGNQTITQGWSATIAQSGQHVTATNPSWATSIGTNGTANFGFNANYSGTNTAPAAFKLNGLACTGTVPNSPPPSSSGPSTGPSTGPSTGPSTGPSTNPGTKVDNPYAGVKGYVNPEWKAKADAEPGGSRVSNNPTAVWLDRIAAIAGTSDSSSNGSMGLRDHLNAALAQGAGYIQLVIYDLPGRDCAALASNGELGPDDLPRYKSEYIDPIAAIEADAKYKNLRIINIVEIDSLPNLVTNTSGQAGGTAMCDTMKANGGYVNGIGYALNKLGAIGNVYNYVDAAHHGWIGWDSNFGPTADIMLSAAKASGNVNNVTGFITDTANYSALREPFVQPTTTVNGQSVRQSKWVDWNQYTDELTFAQAFRQKLISIGFNSNIGMLIDTSRNGWGGSARPTRASTSTDVNTYVNESRIDRRIHAGNWCNQAGAGLGERPTAAPEPGIDAYVWVKPPGESDGSSSLIPNDEGKGFDRMCDPTYTGNARNGNSMSGALPNAPISGAWFSAQFQQLMANAYPPLS

SEQ ID NO: 13894 - protein, 234 aa, Actinoplanes utahensis
MPGAGVLPCPTMTDEVQWRIGGRRVVAAAAGVTGRRYDRNYDVFHLDPDRPLAVVADGMGAGEGSAAAGRITVRTFVALAGDPAPAALRAVTARAHEGVRTQVRTRDGLTGCTLTALTAVADDDGAAVRIVQLGDSRAYRLRDGLLELLTVDHTVAWLGLVHGWYAASDPRAEADGYRLIRYVGHPDRPEPDVVEVAVRPGDRLLLCTDGVSGQLDYPTLGRLLGGAGPAGGSS

SEQ ID NO: 13895 - protein, 234 aa, Actinoplanes utahensis
MTTRTATIAAGIGALALVSVGLPAGVSFAGTDRPVVADRAVVADRAVVADRPAMADRPAMADRPAMAGRAAVADRSATTREEGFLGGEPPVPTALQPPAGNVLHAVLKARGVQIYECRRSMWQLLEAAASLNGATVNPVRKVTAVHFRGPAWVSDQDGSTVAGADPVSAPGAGAGDVPQVLYRATGNRGGGLFGEVTYIQRIATQGGVAPTKSCGGNQPIAVPYHAVYRFFVKK

SEQ ID NO: 13896 - protein, 291 aa, Actinoplanes utahensis
MGPRLNHSARPGELIGDGDVTRRGNDVRHHTALIWATLTGITLAAATAAGPALADVPGFALKVTSPATAKAGGAAPKVTAVVTSNQAGCRKVRWTMVIRGGDVSLDQIRVTRIENGGEFATRVSVTGNTATIVDQQPDPGILCRDRTVTGTWQLAFGGRDGGRVQFEVQAFDERNTRLTAAGSAIEVAGPVATTTPAPRPPQTSASPATSPTGDDGVSEVVTTAPIVQPTRSDNAAALSPAANQSNLLGPGLIVGGVFFFLGLLLILRLRARTRKARGRDEALPTGFYTMP

SEQ ID NO: 13897 - protein, 322 aa, Actinoplanes utahensis
MSTGRSPRTPASHRPRDVTVAENEESMARSKNKERTASRVAVDIGSTGGRSVPPSAVILLVVCVLAAIWAVAMMTKPGRVGYVYFFMYAEYYMGVLTLVSLSITIMVGLVSTDRLVLSIRQRVFLQSTHRTTGVMAISSLAFHLWTKTVEGHIRVIDIFIPFIAQGNNLFYIGLGQISGYILVLVTWSGLIRARFIGRGKPWMWRAIHSISYLMWPIALVHGLSAGRAAKTWVIVSYVICVLLVLIGLAVRLSVSLNRRKDFASAAGVGAAKPSGNVVPTSGGGARGRFGGGRSAREQTTDLLAPAETPAVSSWIPAAPAAS

SEQ ID NO: 13898 - protein, 224 aa, Actinoplanes utahensis
MPRREFEDDRYEEPALRGRRRDDDYYDEEPRPRGRRYADDEVEEEPRGRRAARTSMDDTSTRLRRDEMTETGTRLRIEDTGTGLRRDEMTETGTRLRRDEMTETGTRMRRYADDDAYYDEPARGRRRADAEPRYEDVPRQRAPRYEEDDEPRGGRRRADDGRHSRSEFVDLADDRYADDDSLVDTSARRARRPSADVLRGNPAGRGRARDDDDSYFSQLRGDVN

SEQ ID NO: 13899 - protein, 492 aa, Actinoplanes utahensis
MSTAQVPPVTSIGIPRITAGYDEYGRLDLQAHQEVHGGFAALSSGELIGLTDRIELRGRGGAGFPFARKVRAVIDSCKRQDLPPVIVVNATEGEPPSWKDKAILTRSPHLILDGAALAAAALDAEEIVIGIADDGIGQNSLAAALAERKMPCPTRLVTVPHRFISGEGGALVRGINGEAHIPPGRKVRSSDNGVMGLPTLLSNAETYSQLAIAARLGPWEYNSVGIPEEPGTVMLTVGGSATNPAVVEAPSGTPLMDVLTMCGADIGPGLLVGGYHGKWISAEQAQTVTISRKGFAKVGGTLGAGMLIPIGSKTCALGEVAQVVQYLAGESAGQCGPCRLGLPDLARAVTLVSLGGSALEQVRQAAGLVKGRGACSHPDGTSRFALSALEVFQKDVEAHANGEGCGKQVRGILPLPYTAEKGARKLALDWSRCDGHGLCSAVAPEIIRLDHNGFPAFPQTPLPPWLEDGARKAVNVCPALALRLIDPATAAH

SEQ ID NO: 13900 - protein, 177 aa, Actinoplanes utahensis
MSTRRALLTLPFAMLAAGCAAAPEAATPAAAAGRGSGSAAAPAVPDTLRFSGTTLDGTKFDAAQLAGRPAVLWFWAPWCATCASEAQSVADFHDEYAGRLTFLGIAGLGTAKAMRQFVADLDVGKVTHLNDPSGTIWSKFGIAQQSTYVLLDAAGKIVTRGYLDDLQLTAALKKLAG

SEQ ID NO: 13901 - protein, 88 aa, Actinoplanes utahensis
MTVVATLVVEGPSRSLATLARAVPITVDGAAKGRVRAGKRLTLALPPGSHSIQAGGGPALPVRLAPGLVTRVRVERDAAGRTHLIEVG

SEQ ID NO: 13902 - protein, 82 aa, Actinoplanes utahensis
MNSVHDTMARQGLVRPRDGRMLGGVCAGLGRRFGLDPWLARLLFVLILFLIPGSQILIYPVLWVLMPAEETVYSPHTPPTTW

SEQ ID NO: 13903 - protein, 597 aa, Actinoplanes utahensis
MVDDTVPGERTQPLRPHDPRTLGDYELLGRLGEGGMGTVYLGRRAGSEILVAVKVVRLDLAHDDEFRRRFRSEVERARQVPPFCTAEVLDADPDHEQPYLVVEFVDGPTLADVVERRGPLTSANLHSVAIGVATALTAIHGAGVIHRDLKPRNVLLAPGTPKVIDFGIARAMSATSGNTRPDQMVGTVAYMAPERFNTDSDTPMLTPAADVFAWGSVVTYAGTGKTPFSADSPTATAARILTQPPRLHGLTGPLRDLVAHSLEKDPANRPSARELLDLLISGDRPAATAAALADQPDLRAAAVEAQAVTGYALPSATVTPLPGPALDIPPGLVGYSENSIVTVPIEQTRDTTGTGAPAARPRRRVLPVLLGLLTVLVIAGGLAFTGVLLRDHFAGRSDAAAGPSPVPESGSTGAAPRYADALATEGLWHPTVQDDEQASCAFAKAALVARRETTGTYRCRGPKDVLTDATVEVGVRLDTRYSCAAVWFRFDDKLGGYQLRVCERDVYLSEHRDDVITAPRTLPLTRPIALYATPVRIGLRIQGNAVEISQDDTVIGTLPLKNATLTHGRVVLGVFNDPAAPKAGPYEVAFSDVKIWG

SEQ ID NO: 13904 - protein, 854 aa, Actinoplanes utahensis
MVQECQSPGRVVSSKRAPPLGRPRSPGRFRRSWRCTRPGGSPGSQTSRGRVGKALRVIIYRRVCGAARQAAAASVTIVDVTTAIHQRIASELGVREGQVTAAVELLDGGATVPFIARYRKEVTGTLDDAQLRTLEERLGYLRELEDRRAAVLESIRSQGKLDDALERQILEADTKARLEDIYLPFKPKRRTKAQIAREAGLEPLAVGLLGDPTVDPKAAAEAFVDAEKGVADGQAALDGARAILIERFAEDADLIGELREQMWTRGRLVAKVRDGKQTDGAKFADYFDFAEPYAKLPSHRILAMLRGEKEEVLDLTMEPHPEEDEGYFEGRIAGRNGISNQGRAGDKWLIDTVRWAWRTRILIHLGADLRVRLREAAEDEAVRVFAANLRDLLLAAPAGTRATMGLDPGFRTGVKVAVVDATGKCVDTAVIYPHVPQNRWDESIHKLAALASKHNVELIAIGNGTASRETDKLATELIRRHPDAKLTKVVVSEAGASVYSASAYASQELPGLDVSLRGAVSIARRLQDPLAELVKIDPKSIGVGQYQHDISEVKLARSLDAVVEDCVNGVGVDVNTASAPLLTRVSGITAGLAENIVLHRDQNGPFKNRNEIKKVARLGPKAFEQCAGFLRIRDGEDPLDFSSVHPESYPLVRTIAADAGSDVKTLIGNSPLLKGIRPDKFVTDTVGLPTITDILKELEKPGRDPRPAFTTATFAEGVEKIADLKPGMILEGQVTNVAAFGAFVDIGVHQDGLVHVSALSEKFVQDPREVVKSGDVVKVRVLEVDPVRKRISLTMRLSDEPHRNRPPREDRGGQGGGGQREQRGPGGGPGGQRGQGGGQRGQGGGQGGQRGLAS

SEQ ID NO: 13905 - protein, 297 aa, Actinoplanes utahensis
MITRRAFPTRPRDVWLPGEPPGRVHRHDLRKRPGDRGLPSGGARLLETTLPGLWHSCTMTLAVRAVAATDQGLVRSNNEDSVFVGNRLFVVADGMGGLPAGELASDILVQVLGGVDQKPDTGEPLQDLIEALQVANKQIEKSVAEDDARDGMGTTVTALLLSGDRLAALNVGDSRCYLLRDGDFQQLTRDDTYVQALVDQGVLTPDDARRHPQRALVTQAVQGGPFRPAGRMIPARVGDRYLLCSDGLSDYVEDAVIAQTLRDNADRRTCAAELVNRTLENGAPDNVTVIVADVIEV

SEQ ID NO: 13906 - protein, 184 aa, Actinoplanes utahensis
MLLATERLILRRFRAADAAAFAEYRSDPDVARYQSWDAPFPLNKADVAVRNFAASSPDQPGWFQYAIEHTSERVLIGDVAVRLHDNLRQAEIGFTLATAYQKMGYATEAVSAVLDRLFRLQGLHRVMGECDARNVASAALMERLGFTREGLLRQQTFIKGEWTDDLLYGILAPEWLARESVVPL

SEQ ID NO: 13907 - protein, 160 aa, Actinoplanes utahensis
MSYPCDRIAAMDIDGFWRLIERSAPEPDRDAWLTGTLRKLARVHIEDFEILLQECRDRIDNAATWAAAYVVYDGHCSGDSFRYFQCWLIGQGRAAFERVAAAPDALATLPAIQRLAGRTFRAWDDDEWPDREALAGVAAGAYPDDSLEDVLAERGFRRRE

SEQ ID NO: 13908 - protein, 716 aa, Actinoplanes utahensis
MIGHTTSRLAADERAMNAVIAGDTHDPHAVLGAHPAGGHTVVRTLRKGATNVAVLHDDQRYETTLVHPDGIFAAELPGTVTDYRLDIDGTQCDDPYRHLPTLGELDLHLIGEGRHEKLWRVLGAQPRGAGVAFAVWAPGARGVQVIGDFAGWGPFDGWPMRSLGSSGVWELYVPNAHIGTKYKYKILGRDGVWREHADPLAQHTEVPPATASVVFQSSYEWHDESWMRSRASKAWHQEPISCYEVHLGSWRPGLTYLELADQLVDYVVETGFTHVELMPVMEHPFGGSWGYQVTGYFAPTSRFGNPDEFRHLVDKLHQAGIGVILDWVPAHFPKDEWALARFDGTPLYEHGDWRRGEHPDWGTYVFDFGRKEVRNFLVANALYWCEEFHADGLRVDAVASMLYLDYSRKDGEWTPNQYGGRENLDAISFLQEMNATVYKHHPGVMTIAEESTAWPGVTRPTHLGGLGFGFKWNMGWMNDTLAYMTKEPIHRQWHHHQMTFATVYAWSENYILPISHDEVVHGKGSLTGKMPGDLWQKLANTRALLGFMWAFTGKQLLFMGAEMGDLREWSEERGLDWGLLDDPQFGGVKGLITDLNRVYRETPAVWTQDTSASGFRWITSDDSQHNTFSFLRFAPNGDPMACIVNFAAVPHENYRIGLPRAGRWTEAINTDSELYGGSGVGNMGAVEAEDIPWHGFDHSAALRVPPLGALWLKLDH

SEQ ID NO: 13909 - protein, 437 aa, Actinoplanes utahensis
MTLPYTEWLPKQRWYAGRSRVLASLKEASSTPLGEELELVLLDVSYTDGSSERYQVLIARGAELLPEYSAVATIGTDEQGRVAYDALYSPDAARYLLGLVDRSEPVADLTFEKEPGVELPLDKWPRVFDAEQSNTSVIFEQDAILKVFRRVTCGINPDIELNRVLGRAENPHVARLLGSFETTDDAGQCSLGMVTAYAANSAEGWAMATASARDLFADAEMAADEVGGDFQGESYRLGEAVASVHLTLAEQLGSGPSPFPVDAVLARLRTAANAVPELQQYVPAITAKFEALTGHQVTVQRVHGDLHLGQVLRTPEAWLLIDFEGEPGQPLDERRLPDSPLRDVAGVLRSYEYAAYQLLVDQEDDEHLAARAREWVDRNRAAFCDGYAHAAGLDPRAEGALLAAYELDKAVYEAAYEARHRPGWLRIPLRSIARLAG

SEQ ID NO: 13910 - protein, 585 aa, Actinoplanes utahensis
MDLTSEHDPAEGSHTEDGMVEHPSADDFGHARALPADRTWFQRAVFYEVLVRAFYDSGSDGGGDLRGLIERLDYLQWLGVDCLWLPPFYDSPLRDGGYDIRDFYKVLPEFGTVDDFVALLDAAHKRGIRVITDLVMNHTSDSHPWFQASRHDPDGPYGDFYVWNDTSEKYKDARIIFVDTEESNWTFDPVRRQFYWHRFFSHQPDLNYENPAVQEAMLDVLRFWLDLGIDGFRLDAVPYLFEEEGTNCENLSQTHAFLKHCRKVIDDEFPGRVLLAEANQWPADVVEYFGDAKSGGDECHMAFHFPLMPRIFMAVRRESRFPISEILAQTPAIPENCQWGIFLRNHDELTLEMVTDEERDYMYAEYAKDPRMKANVGIRRRLAPLLENDRNQIELFTALLLSLPGSPVLYYGDEIGMGDNIWLGDRDGVRTPMQWTPDRNAGFSTATPGRLYLPVNQDPVYGYQAVNVEAQRDSATSLLNWTRTMLAVRRRHEAFAVGTFRELGGSNPSVLAFLREFGDDVVLCVNNLSRFPQPIELNLQHWNGYTPVELTGHVNFPRIGQLPYLLTLPGHGFYWFQLCGSEEKQ

SEQ ID NO: 13911 - protein, 654 aa, Actinoplanes utahensis
MTGRFPIEDVTPAVSGGRYPAKAVVGELVPVSAVSYREGHHALGVNVVWRGPDGQPQAFTRMTPGTPGLDQWHAAIRPDQVGRWTFTIEAFDDPYRTWRDAVVKKIGAGQGAEDLANDLAEGADILDLATKIVPAEHEERVRAASAALRDEQRSLFSRVTPGLDLEELLWHNPVRHLVTTTRSFAIWVDRQRALYSAWYEFFPRSEGAEIGPDATPIRHGTFRTAALRLPAIAEMGFNVVYLPPIHPIGRINRKGRNNTLVARPVDVGSPWAIGSEEGGHDAIHPELGTLEDFIAFRERAEELGMEVALDLALQAAPDHPWVSEHPEFFTTKADGTIAYAENPPKKYQDIYPINWDNDYRTLRDEVYRVVMHWVNAGVRIFRVDNPHTKAVNFWQWLIPKVKESHPDVLFLAEAFTRPAMMNGLGKIGFTQSYTYFTWRTTAQEMREYMEQLLTSIDWMRPNFWPNTPDILHESLQHGGPPMFKIRAVLASMLTPSWGMYSGYELFEHVPRPGSEEYIDNEKFELKPRDYAAAERAGRSLAPYLTKLNRIREQNPALHWLRNLRFHEIDNGALLCFSKRDADTGNTVLVIVSFDSANVQWGNTTLDMPALGKDWHEKFTVVDQISGATYEWGQYNAVRIDPYVEPAHIFVVQAG

SEQ ID NO: 13912 - protein, 198 aa, Actinoplanes utahensis
MSGPSTALSPVIAASTHWLARAYPGGESNTVAHTLSELQARQAVTVAAWLRYPTEIDAALVAIAGPGGSAILDWKAGSEPDDEFAEGEGWRTWVDEVVVSWAACLLADPALARRGVDAVIAAIPIPEPRPRPHARRTGGLPSEFRRLLQPDARDREAATLLRHPDLLEPIAAMHRDTLLYLLDAEPAGLAPLGGDRAA

SEQ ID NO: 13913 - protein, 155 aa, Actinoplanes utahensis
MARTIATNDRVSREELVAFLRPRHHAILMTVRRDGRPQSSPNTCGVDEQGRIVISSYPERAKVANLRRDPRVSVCVLSDEWNGPWVQVDGTAEVIDLPDAVEPLVEYFRCISGEHPNWDEYRQAMRDQGKCLIRITVDGWGPIATGGFPARLADN

SEQ ID NO: 13914 - protein, 283 aa, Actinoplanes utahensis
MTILGIDIGGSGVKGAPVDTTRGELLDERFRVPTPQPADVDSVVDAVAEVAAKFDGFDSIGVTFPGVVVDGVTRTAANVHKSWIDAPAARLFGERLGRPVTVLNDADAAGVAEVAFGAGRDRSGLIMMVTLGTGIGTAMFLDGVLLPNTELGHLEIDGKDAELLASDRVREAEDMSWEKYAHRVSKYLRHVEMLLSPRLFIIGGGVSKKADKYFPLLEVRTPVVAATLLNNAGIIGAAVSAEQAAAGPGGQHPGSIPVHAGAPGAEPHTVNAGRPASDAEDRH

SEQ ID NO: 13915 - protein, 269 aa, Actinoplanes utahensis
MTTAPLHIHRSAGTASADPAPEATATELLDAMAVLPVGQRRCRVRDRAIEAWLPLARHLANRYAGRGEPTDDLIQTATVGLIKAVDKFDPERGVDFAGYAIPTIIGEIKRHFRDRTWSVRVPRRLQELRLAITEANSTLTHALGRSPTVPDIAVHLGISEEDVLEGLEGARAYNATSLSTPINADGTTELGDTLGAEDHEYELAETRVALGPALALLDEREQRILTLRFYGNLTQSQIADQIGISQMHVSRLLTKALAKLRTQLAAETL

SEQ ID NO: 13916 - protein, 181 aa, Actinoplanes utahensis
MTTPSPEVPAGPAGVPQVPARASLDDPRHAGPTVVVGTYPEYAQAQQAVDHLSDNRFPVERTSIIGTDLRLVETVLGRLTTGRAALAGAASGAWFGLFIGVLFGLFGNANWFSVILTTVLIGAVWGAVFGAIAHAATGGRRDFTSRSSLQAAQYAVLADAEVADAAKALLVRLNWQASGAS

SEQ ID NO: 13917 - protein, 301 aa, Actinoplanes utahensis
MTAVATRRTNVTGDTPSTWHSISPLVVAILAAAGGYLVYLGFIRTGLGQSIDTAALRGGDVHHEQVTLVLSRTLEATQLAVLGVVCLVAVAVGAVRRRFDLSIGATLLVIAANLAVQQLKSHLSRPDLDGTGMPNSFPSGHTAAAASVAFVLILAFPRALRGAMGLLGAAYVTIVAVATVWAEWHRPSDTIAALFIVLACGALITWVIRLRRIGGARPSIAPARVATLPLALVAAIGTAACLFGLATVAVSERVMPDLVSGRFAFLTGVAGIVAAVAGTFYFWVRLTAGDPLPEPQQGGKS

SEQ ID NO: 13918 - protein, 838 aa, Actinoplanes utahensis
MLSDLGRVPHLRVDGRLVPRPRKLPAGEQPVRAGLRLHPGRQQLHLAGVEGRVRHRPELLHQGDRPDDRVQPVPVRHLEIASRSDPGVLRHTLHVVEGRSRYTGPALATAVVLAGLLCTLLTVAGLRGAQRDNARHVMDQRTRMALSAVTAETDRYRDLLETLAAGLADQPALTWAGFDQASAPLAGAGLKGAAAIAFVAPVATAGVAAAERSWRARGASGLTLRPAAGLGEHYFTVFSRNLNEDETVTATGGTDVAGVPQPAAALQTARQTGSTAVSDTYVLLRDRDIPAAQRQHSFVFAAPIWTRANNPVFRGWVVLGLRGGDFLAGVLSTVSQQQLDGSLVAVNSDGTRAEVATLRVPGKRDLRREQAVPVADHVWELTLQADSARLPGAGGHLPGTVLAGGLLLSILLAGLVQVLAGGRYRARLRVEQATTELRAAEAESRRQAGLLGAIMTTIGDGVSVIDADGRMLLENPAARRLTGVTESSDAPERWQRHYGVYRPDRVTPLPVDEMPLIRALHGETVEGAELFVRNPGRPDGVLLGVDARPLDPSAGLRGAVAVYRDVTGLRRYEQDLSIFAGVVAHDLRAPLAIVRGHCELALDDPGDEAEVRSSLGRIIRSVDRMDALIETLLAYSTARDAPLNVVDLDLEPLVREVLQERAASLRGQGGAEPRWSVGPLPSVRADPAMLRHVLDNLVGNAFKYVRPGAVPCADVTAGPAAVPGWTRIEVSDAGIGIPEPEKARVFESFHRAQGSAGYAGTGLGLAICHRVVVRHGGEIGVEDNPGGGTRFYFTLPLSPAATREENDMRHIPAEPAEQEDARVRAALDRALAERAAVL

SEQ ID NO: 13919 - protein, 129 aa, Actinoplanes utahensis
MIVVAEDHDDIRYVLKRSLERAGHRVVVAADGVAALAAIKEHRPDLVVTDVDMPQMTGLDLCRAIKADDDLRHIPVVVASGSLLPGDERASDAGAAATLLKPFVPAQLLALVAALIPQPATDGAGPRTG

SEQ ID NO: 13920 - protein, 371 aa, Actinoplanes utahensis
MTGRTVIRTVRRVNPDHQDGELIPGDDAPPRRRGWFGRRPGWQKALILIAVLVVVLTGGVAGGGLLLVDHYTGKVDRAALLPSPPADEAAQSRQNWQNGALNLLLLGSDSRAAEPGEKSPIGERSDTIMLVHINRARDHATIVSIPRDSYVDVPAGGTWKGGKNKINAAFAFGGAALTATTVRKLTGIPLDGAMIANFASIRDLVDAVGGVDVCVPYDVKSTFSDREWKPGCHDMTGDIAEEFMRQRYNVPGGDFGRIHNQQLVVQAVISKVARNNLLYKPLALDELLGIAADSLTVDENLDLRDLVLAVRDIRPRNIAYATVPYTSANLKTPAGAAVQLDTGAAAEMFAAVGNDTIDQWLADHPQHFPGS

SEQ ID NO: 13921 - protein, 1307 aa, Actinoplanes utahensis
MSTSPSAPPAELRSRITQLLPRDEHRIGRRLEGTRRIRDDAAKSAALAEITAEVERAEARLASRAATVPPITYPEALPVSARKDDIAAAIRDHQVVVVAGETGSGKTTQIPKICLELGRGVRGQIGHTQPRRIAARTVAERIAEELDRPLGATVGYKVRFTDQAGEDTLVKVMTDGILLAEIQTDRMLRRYDTLIIDEAHERSLNIDFILGYLRDLLPKRPDLKLIITSATIETQRFAEHFADAAGQPAPVIEVSGRTYPVEVRYRPLITTQVIDDDEIREEPIDQIEGIAAAVDELPADGDILVFLSGEREIRDTADALTRKDLRNTEVVPLYGRLSAAEQHRVFERHTGRRIVLATNVAETSLTVPGIRYVIDPGTARISRYSSRLKVQRLPIEAVSQASANQRKGRCGRTSDGICIRLYSEEDFDGRPEFTEPEILRTNLASVILQMTNLGLGDLAKFPFIDPPDKRNITDGIKLLEELGALQDRKLTPIGRQLAQLPVDPRLARMVIEADRQECVAEVMVIAAALSIQDPRERPADRQQQADEKHSRFTDKESDFFTYLNLWRYLRQKQQELSGNQFRRLCRAEFLNYLRVREWQDIYAQLRQVVRTLELNFREDWESGVAPQPVHTALLAGLLSHIGLKDTDKREYLGARGAKFAIFPGSALFKRQPRWLMSAELVETSRLWARVNARIEPEWAEKLAPHLVKHSYSEPHWDRKMGAVMAFEKVTLYGLPIIPRRRVGYGKIDPVVARDLFIRHALVEGDWDTHHKFFEANRQLLRRITELENRARRRDIAVDDEAVHALYDARIPADIVSSRHFDGWWKKARHENPDLLTFTREDLVNAGRDTVDPNAFPDAWLAGGVKLPLLYEFEPNSHADGVTVRVPLDLINKIDADDFGWSVPGFRKDVVIALIRALPKALRTSFVPVPDWADAVLDRVPVRRGPLPDAIAGELRRLSGTIVPRDAWRPDQVPDHLRMNFRIVNEAGEVVAEGRDLDVLRRALAPKVQATISRAAGNLERTGITTNDFGAIPHRVAQQRGGYAVTVWPALVDEGASVGVKVFETEAEQRVAMRAGTRRLLLLTLPPAARFLQGRLDNRAKLELSRANPYRSIADLLDDCAGAAVDRLVADAGGPVWSSVEFASLRDTVREDLVDAVANVVTQVQAVLSTAYDVDQRIRQLKDPGLLPALADIRQQLKGLVYPGFVTETGWRQLHHLPRYLKAIAHRMDRLGGGVGRDRQLTTQIHEIETEYRELLAEAPPGGPAAEGLREIRWMLEELRVSFFAQSLGTAYPVSDKRIFKAMDALPL

SEQ ID NO: 13922 - protein, 122 aa, Actinoplanes utahensis
MTNRAAASAPVSAVSAAVYLDEMMARVGVDGLAAAFAAPGLLATLDQHAAAVREAVLGAGRMLDADGLAAYARSIAAAAVRAGRPLPAPGAAPTTVAGWSAAAWPMVRMVAVCLIAESAGLL

SEQ ID NO: 13923 - protein, 243 aa, Actinoplanes utahensis
MRMFKLSALALLTVPVMAAPAAAAPVVDPPSTLVARYNFDGGATAGKISDLSGKGSSLTVRGEDNGTVAINTEGAGRYASFPAVCSGTGSCARALLEAPNSPDLNPGVRTFHWAASIRVTQAQLHGKANIMQKGLAGADSVWKMQLTGKNGRAVCIMTGKGSAQTFSAISSKPLADGTWHKVVCERTPTSLGISVDGTAGSHVTIPATLSVDNTMPLRIGGPNFGATSDMYHGQLDDVYIQVG

SEQ ID NO: 13924 - protein, 80 aa, Actinoplanes utahensis
MPAQPFSVHPDLAELARRDIAAALTRPAVEDGSGAQPDPADAAHHGARDTRQAARRSSDRAHAGRAAGAGGGRSYAFRRS

SEQ ID NO: 13925 - protein, 418 aa, Actinoplanes utahensis
MITSVTVHSLDDPDLHDEYLRLVGDGDEYAAVELALTLLDNGVRPQRIMVDLIGGTQARVGELWAANEWSVAREHAATAVNERVLAAVAAHLRPSPRRSSTTADRDLSAADRSPATADRDPSAARGVAGPDAGASPADRGTAGPGRDAAHAHRGGASTYRGRITVACVDGEWHGLPARILAELLSLDGWRVDFLGASVPGPHLITHLHQTGPDAVALSCMIPTRLPRAHAAITACRAAGVPVIAGGRGFGPQARWAARLGADAWATSAEEAVVRLATDWPPPPAPDFPASGGFVPSSLSEHLGDEEYTHLVRSRPQLIDTAMQRLAAVHPEVRDYDDRQREATAEDFGHIADFLAASLYIDEPQIFRDFTSWTADVLTARLVPVTALRAGLHIVRDQLIDFPTATKTLDLALADLSTP

SEQ ID NO: 13926 - protein, 561 aa, Actinoplanes utahensis
MSARMPATAAPPGLLRAVLDAASEAMLLCAAAGDTVVLVNEAARALLPGLQPGDPLTAAPLPELAAAAAAGGESFRSEDRQHCWYGRRRAVGDEHYVWFLADGAAERDRTAALEAERARAAFLADAGRRLSASLHSRLVRRTTVELAAAHLADAAVVILPPDKRQSAWSRALPGHPVEEGTLPERNLAEVPGLGEVIDGFPPIPSRWLDPAQTPGWLFPAALGPLGALLVIPLPGNAEPAGALILARTGTFSPEEEALARVYAARAGAALAAAALYQEQVATAAVLQADLLPPELPEIDGFELAGSYQAARETMLVGGDFYEVFGPVPGSTDTVVALGDVCGTGPEAAVLTGKVRQTLRALRLMHAGPETMLRVLNRALTDSGRRQRFVTLVVGSVTRVDHGRICLELASGGHPPPLVLRADGRVEEVPTGGTLIGVMPETTVRPATAELGPGELCLLYSDGLTEARGGPAGDEQFGETRLRRALSDCAGLPGAVTLERLRQLVSDWVRGGPGDDIAMLAVRAHPRPPLSLRDGGATLRAPNQSPYLTAARRPDRRVRPRS

SEQ ID NO: 13927 - protein, 257 aa, Actinoplanes utahensis
MRFATWNVNSVKARLPRLLEWLETAAPDVVGLQETKVAEDGFPAAEVRELGYRTAAYGQGRWNGVALLSRIGLDEVRRGFPGEPGYPGPEARAISAVCDGIRFMSVYVPNGRTPDDPHYTYKLQWLRALRLALADDLAAGPLIVAGDFNVAPTDDDVWDPSVFAGSTHVTEPERAAIAALRDLGLTDVPARAMKGDHPFTYWDYRAGMFHQNKGMRIDHVYASAELAAAVTDAVVDREARKGKGPSDHAPVIVDVKR

SEQ ID NO: 13928 - protein, 182 aa, Actinoplanes utahensis
MPVVPDELRDGAWDFYRESFADLAVLAVHRHVLHREEFDELMADERAPKYVAYDAEDRVAGMASMTTELDAVSLISPDYFRHHWPELYAQRRIFYVLFVGAARGARGAGVFVALLRRLYAPIAEVDGKVFVDICTYNEERHQLPRMIGVILGRVSGKAVPTRLDAQSFWLYEFPGNGLPESV

SEQ ID NO: 13929 - protein, 776 aa, Actinoplanes utahensis
MLSVLPPGIARRQWQLMAVIGVLATALYAAYSSSSLASVSLVVLGVLTVAACFVGPRRWGAEPPVAWLLMALAATLFLVGLLIRPTVTNQPMPLPLLADAASFSGYLLLGAFLFMLLRARQSLERHAVLDGLIVCLAAGLTSTLLLAAPAAAIAGRPALLSIIQGTYPLFDIVLALLVINLAFTTKTWPISMVALLVMMIGLFLGDTAYAIVGVNGHIYASPLLNVPYVLAYTALGVAALHPSVTEMSRADRLPVQAWSWQRLAVLLPALFLPFALLLTTGTSAASHRLLIAVAGALMVVLLLARAMSAVHAQVAAQLHSEHQATHDPLTGLPNRQSISAEIERLVTGVGGQQRVWVYMLDLDGFKWVNDSWGHDTGDQLVIEVGRRLRAAVPEAVPVARVGGDEFLLAFVGDKAGALRLVDDIRGCFARSLPVRDTEVVISASIGIAHSVGDAVRSAVTAEALMRDADTAMYRAKGDGPGRSTIFDTSMHDQVRERIELEVALRQALTDDQLYVVYQPIVRLETGMPVGAEALIRWEHPERGSIPPMLFIPIAEDSGMISQIGTFVRNEALRQLGVWRSQGVVSESFYLSVNVSPRQLSEPELPLVVSGELFRYGVPAHCVALEMTESVMVDGSSVTARVLHELRQLGLKLLVDDFGTGFSALGYLRRFPVTGVKIDRSFVTGLGKNDQDDEIVRAVVAMSHALGLSVIAEGVETPLQREALYHVGVVNGQGWLWGKAVPAAEFAERWHLTAALPEVPLPVATVTSSGRHRRIDD

SEQ ID NO: 13930 - protein, 247 aa, Actinoplanes utahensis
MRIPNQPPVVAGVAGTAGGLSAVRLAAREAVSRGTQLSIVHAFAWDGAEARRAAAHVVEEAVATAQRCTPGADVRGQLVDGSAGSVLRRFSRTAALLVVGATDLPTSSLLEAVTQAWCPVLVARGARPAAGPVLAAVDGSGPSVLALRHAAAEAVRRGLPLEVAGDDDAVLDRVLAGLPDLPSPERRLLTGDPAGALVRLSQRVALLALGPRGAGGAARFGSVAHELLRHGGCPTVFVHGRREPLLR

SEQ ID NO: 13931 - protein, 427 aa, Actinoplanes utahensis
MTDVKLDHPGGQLSMGVREAVDGPGGIDVSALLKETGYVTLDQGFVNTASTTSAITYIDGDAGILRYRGYPIEQLAEKSTFLEVSYLLMNGELPTEAQLRDFADKIRVHTLLQEEMRTFFSGFPRDAHPMAVLSSAVTALSTFYQDALDPLDDEQVDISAIRLMAKLPTIAAYIYKKSIGHPLPYPDNSLDYVENFLRLTFGLPTVNYDVDPKVAKILDMLFILHADHEQNCSTSSVRLVGSSQANLFASISAGISALSGPLHGGANAAVLEMLEQIRKDGGDVNSFVTRVKNKEKGVKLMGFGHRVYKNYDPRAAIVKKAAQEMLSTLETPDPLLEIAFQLEEIALNDEYFVSRKLYPNVDFYTGLIYKAMGFPTKMFTVLFAIGRLPGWIAQWQEMMHDPANKIGRPRQIYTGSPVRDFVPMSQR

SEQ ID NO: 13932 - protein, 101 aa, Actinoplanes utahensis
MDVIGALAEPARRRIAEVLLTGDASVGDLVDALRMSQPAVSKHLRVLRDAGVVTVRAHAQQRIYHLEAGPFRQLDAWLTPYRRLWSRHRDALGEHLLEEEP

SEQ ID NO: 13933 - protein, 173 aa, Actinoplanes utahensis
MTGPQPQARVAADGDRWTLILIRDLPQPPGEVWDALTDPERLDRWAPFTADRPLTAPGPATLTLVDGDERTALPAEIVRVEPPHLLEYTWGEDLLRWELAAAAGGTRLTLRHTLTDRDMDAMVAAGWDLCTGVLRRLLDGESVSAIRGRSAMDHGWRDLRDRYAEQFRSDSGS

SEQ ID NO: 13934 - protein, 116 aa, Actinoplanes utahensis
MAVQGLQRIIVSVADLDRALGLYRDALGLTVTAQFGEIARLDVPGTTTELMLHQRPPTAGLAGVAASFRVDDVDATTAAAEKAGATVVDAPADQPWGERQAVLTDPDGHVICLVAV

SEQ ID NO: 13935 - protein, 424 aa, Actinoplanes utahensis
MTTPYPFSAVVGLDDLRLALLLTSVSPAVGGVLVRGEKGTAKSTVVRALAGLLPPVTVVRGCRFACDPAAPDPDCPDGPHPADTPAGHRAATLVELPVGATEDRVVGTLDIQRALADGVKAYEPGLLAAAHRGVLYVDEVNLLPDHLVDLLLDAAAMGRAHVERDGVSVKHAARFLLVGTMNPEEGEPRPQLVDRFGLVVTVAAPRDARLRAEVVRRRLAYELDPAGFAARFADDEREYAARIAAARALLPSVTLPDAELDRIARICLAYGVDGMRADIVVARCAVAMAAWHGRDVVTATDVADAARLALPHRRRTDPLDPPGTDEEKLDQALAEAERQAQDEAGRQAQQEAERQAREDDGGPDGDGPDDTPDGGPRDGGPDDGGPGPDGGGPGGGPAGDPPPGPPSSSAPPTEAPASDGGSPD

SEQ ID NO: 13936 - protein, 22 aa, Actinoplanes utahensis
MPLDELEAATARSAERGYRHAA

SEQ ID NO: 13937 - protein, 199 aa, Actinoplanes utahensis
MPQGKVTTVPDDGLTTRQRRRQAVFAVHTGPGKGKSTAAFGMALRAWSAGWPIGVFQFVKSQKWKVGEETALKALDGVNGTPVTWHKMGEGWSWIQRAGTERDHAAEAAEGWAQIKRDLAAETYRFYVLDEFTYPMKWGWVDVADVVATLTERPGTQHVVITGRDAHPDLIEAADLVTEMTKIKHPMDAGRKGQQGIEW

SEQ ID NO: 13938 - protein, 200 aa, Actinoplanes utahensis
MVTIPRVVIAAPASGHGKTTVATGLLAAFARRGTPVAPFKVGPDYIDPGYHSLAAGRPGRNLDPVLVGEELIGPLFAHGARGADLAVVEGVMGLYDGRTGAGETGSTAQVAALLQAPVILVVDAAAQGRSIAAVVHGFRSFGTVRLAGVILNRVGSDRHEQILRDACEEVGTPVLGALRRADAVAAPSRHLGLVPAAERR

SEQ ID NO: 13939 - protein, 50 aa, Actinoplanes utahensis
MPSPSGRVAELAGTPSVAEAAALRAAGPGAVLILPKRIFGGVTVAIAGPV

SEQ ID NO: 13940 - protein, 492 aa, Actinoplanes utahensis
MGEKVEQTQFSREDRSRYRQKVRRSLDVFATMLREARFDFERPMTGMEIELNLIDGQAGPAMRNAEVLGAIADPDFQTELGQFNIEINLPPRRLAGDDIADLEKGLRASLNHAEGKARTVGVHLVTVGILPTLRREHLTGAALSANPRYALLNEQIFAARGEDLDIRIDGVDRLAVTTDTIAPEAACTSTQFHLQVSPAQFAAYWNASQVISGIQVALGANSPLLFGRELWRETRIPLFEQATDTRSEEIRAQGVRPRVWFGERWITSVFDLFEENVRYFPALLPICDEDDPADLLERGDTPALSELRLHNGTVYRWNRPIYDVVGGRPHLRVENRVMPAGPTVADTMANAAFYYGLARHLAEAERPVWTQLSFRAAEENFHACARHGIDASVFWPGVGTVPVTELVLRRLLPQAADGLDRWGVSTAQRDRLMGIIEQRCLRQQNGASWQVETLHELEKQGMERQRALHEMMRRYLPLMHENIPVHEWPVGV

SEQ ID NO: 13941 - protein, 173 aa, Actinoplanes utahensis
MDDTELHRERILRHVSPIITGRFIGFQPSYTREVRVGRPLAVAVFLTAGIAQLLAALLRMKPARRSLRELRSGPEFLVTPVRLRDDLGQTYEIEMHGQLPQSALHRGDLVQVRTEPQRDRTLPVRLTQVVNLTTMQPLTPRIPTRWSHLGPAMLLQAAAGLVVAGIIMAAILR

SEQ ID NO: 13942 - protein, 382 aa, Actinoplanes utahensis
MAPTNYVKPDSVLARTARDMLAAHAGGEGPREGLTRCPACGEPLPCRSGQAAAEVLAAAGLAEASGLVAATRVAFAPPPGQPAFLPSWTASEEVADPLGSGPIAGGTPSALAPWAAVAPSADPLTDPLPGASEGPLSGASAGPLSGASAGPLPGASAGPLSGASVGPLPGASAGPPAGDGGESAGGPLSTELPRWATEPTGTHERPWASAGGESWTESRLGGLPRTGGGQSGAGAGGNAGPAPAATGPGANSGPGFISQTSSNGTNGAPSASGLTVSGLGSAEPPPGGEATPEAGRHGRDGTPGVNGAAADASPLRAWATGDEPSPADGRTSSGQPSSGQPSSGQPSSGQPSSGQPSSAQPSSGQPFVSRSPEGRAPGRGAH

SEQ ID NO: 13943 - protein, 375 aa, Actinoplanes utahensis
MRAWPPAEDGPASGSGGGLRAWPSAESGETAQDGGQRAWPATDGTSATGSGSGLRAWPPVGETGTTDFGTPGSGPGAGAGATGSGDIGVEPSGGRPGSGLTGMGGAGASLADSPGSGLAGAPGTGEPGSGPAGLGGWGASAAGLGGPGASALGVSAPGLGGVGSSVAGPGAPGSGEGGSAASGGVGAGAAGGGLRAWPPPESVPGGAGSPTGNATGSAAVPGVGGAAGGDRAWPPAAAVEKPVSGGLKPWPPADDTPGDAAGSGLSAPSGLGGPAGPTGLGAGTGVNLPSLSDDAGNAPAAAMTGTPPWATSAPADSPVNPAWPAPGNPGGDGVAGTGVPPMTAVPGDNGDGAPPPWAVAAPGAVQQPTAPPPAG

SEQ ID NO: 13944 - protein, 178 aa, Actinoplanes utahensis
MGQARPGLQPSDMGQHKAPAGAAQRSGLQAPDMGQHKAPAGAAQRSGLQAPDMGQHNPPAGPAQRSGLQAPDMGQHNPPADGAARSGLQPPDMGQHNRPGALQVPDMGQTRPGLQAPDMGQHTPPAADQAEPSGAPMDETSAPSGLPGRAGAQPSRGAGPAEDGPDDPASAPSGLPRR

SEQ ID NO: 13945 - protein, 245 aa, Actinoplanes utahensis
MPSQLVCRPEQDLPVAVLSVSGTLDRLTGDALGLAVRRSLAVQPVKLLLDVSRLKVADPLALGTFGSVVCQTAEFPNVPIVVCGADPGTCAALAAAPDCAAVEMATDCAAALAEAGRQPLPESVRIRLRPVPDACRQVRHLVDQACARWHRTEFAATAALIATELVANVVRHAHTTMVFTLGLRDGTITMAVRDGSRRLPRSLDPGVSDAGGRGLRLVRELSAAWGVLPVSDGKVVWTQLTPALR

SEQ ID NO: 13946 - protein, 757 aa, Actinoplanes utahensis
MKNRFRKFLQRPGTTVDLGPLSRRLEPIEAREEALKELDDAALTDAAREAADFTEVCAVGREAARRAIGQRPYDVQLLGAMALLSGRVAEMATGEGKTLTATIAAYGHTRLGNGPVHVLTVNDYLAKRDAEWMEPIYTLLGLTVGSVTEAMTPQERREAYACDVTYVSVSEAGFDYLRDQLVTDVADRVQRELATAIVDEADSILIDEARVPMVLAGSTSSESDPVHEAAELVRTLRAGKDYEVAEDGRSVAFTESGLKNVEEQLGGVDLYADDQVATLSAVNVALHAHALLRRDVDYIVRNGGVELIDEMRGRVAQRRRWPDGLQAAVEAKEGLSATAEGEVLNTITVQAFIALYRTVCGMTATAVHVGEQLREYFKLEVAVVPPNTPNIREDDPDRIYSAHDTRDEALVEEIKIAHEKGRPVLIGTLDVQASETLAAQLAEAGVPCSVLNAKNDAEEAAIIAEAGAVGAVTVSTQMAGRGVDIRLGGSDEKDRDRVVELGGLYVIGAGRHDSRRVDDQLRGRAGRQGDPGTSVFFVSLEDELVSRHAGNILPASPRMDMDGVVHDPQVDYAVEHAQRVAEGVNHEIHRNTWRYSVVIEQQRLLLAERRERLLTSEVAAIMLLERSSEKAKETDEDVLSDAARAIALFHLDRLWADHLAYLSEVREGVHLRALGKLDPLDEFHRSAVPAFQDLLTKVEERTIETFEEVDLTDGWEPDRAEIVRPSATWTYLVHDNPFGSELDRLIAAVGRRLTAGG

SEQ ID NO: 13947 - protein, 184 aa, Actinoplanes utahensis
MPVSALSPRADRRSAGPGRGPGNRRTEPALTVTLAIPLTGDAVSPQAHRLLAAVRELVEMSRGTVTVESASAAAESEPEPVPTGPEVRLLTGSRQVLLEGEPVPLTRLEFDLLLYLAERPRRVFSRAQLLAGVWGYERAGERTVDVHVRRLRLKLGASVPAVTTVYGVGYRLADDARITIMPHD

SEQ ID NO: 13948 - protein, 210 aa, Actinoplanes utahensis
MRARPVSFTVLIDDLADRLAGRESDSRIRVAVDGADAADPARLADALVDPLRVRGRPAVRIDTRDFLRPASVRLEFGRANPDSFYAGWFDEAGLIREVLDPAGPGGSGRIVTRLWDAAVDRAAREPYRSLPDNAVVLVSGPLLLGSGLPFDFTVHLAVSPAALDRRTTSDDRWTLPAFVRYADEVAPETFADVVVRLDDPRHPALVTALG

SEQ ID NO: 13949 - protein, 180 aa, Actinoplanes utahensis
MLRLLFRGGLVWDPRRWVSGGSTSRSGTHRQGLREGQGDYMLVNGAVVAGKGASTVKARSADELDQIRVLLRTRFEELDAEYEEAVAQSHRLRLVEIGDSAGDDQADSGSKTAERDAAGSLLRTLLDRRTQAEYAMQRLEDGTYGNCEGCSNPIPVERLEVFPSATTCVNCKQVRERRAS

SEQ ID NO: 13950 - protein, 310 aa, Actinoplanes utahensis
MVSGPAGAGTGTGMGNIRIGTCGWTDKTLIRSGWYPPAADTPEKRLAYYARQFPIVEVDSTYYGPPSEQTTKLWAARTPAGFTFNIKAFSLLTGHPTRVSALYKDLRPDTAKANVYPQDLPPQAYEEVWSRFLTALDPLAEAGKLGALLFQFPPWFGIRRSNKEFLLEVAARCRPLRPVFEFRNAAWFEGGNREETLGFLKDNNLAYVVVDMPQGHKSSVPPILTATADLAVVRFHGHSDKWTSKDIGEKFGYRYSDEELADWVPKLRALSGEAKNTHVLMNNCLSDYAQRNATTLLDLLDDAAVPAPAT

SEQ ID NO: 13951 - protein, 279 aa, Actinoplanes utahensis
MPRWKRCDCGYAGGVLWIGTSGWQYRDWRPGKGAQDAGFLYPAGLPQRLWLEHYAERFATVEVNNAFYRLPERKTFADWRERTPDGFVVAVKMSRYLTHIKRLREPAEPVGRFLDRAAGLGDKLGPVLLQLPPNLRADLGALDETLGLFPAGVRVAVEPRHASWFTAGCEEVLRRHGAALCWADRGGRPVTPLWRTAGFGYLRLHEGGARPWPRYGRAALASWLDRVAAHDVPDNFVFFNNDPGGAAVIDAAVLARMAERRGLSVSRVPVMKPRHPHSG

SEQ ID NO: 13952 - protein, 58 aa, Actinoplanes utahensis
MSEEPETPVAAAGDQTGPEFDPAGDFEYDEAHGAGHHQDIPATLEEEAERRRTLAAPR

SEQ ID NO: 13953 - protein, 233 aa, Actinoplanes utahensis
MSDLERADFDRADYRTVLRRLTTLDQRAADLRTEAVAWHAEQHAAADEAVRVAGERVRDARRAVRDAQRELEEVDARAAGLWSDYVHKVGSVAERFGRLPPASIPRQRADDRTAQEHLAEVEKRVKWTPPARPITFGVKTLFVIFGLVGGILGAIGNQILRSTGAASRGDWHQAAPVVALLVLLACPMLAVVAAKPVADRRKVGLDTATVVTVLVTGLVTAMLLFTAVQYAQG

SEQ ID NO: 13954 - protein, 754 aa, Actinoplanes utahensis
MPALVQLLDHGHVVVQGDRRLGDDVVAGLLLRALGTSTPGTVRVIGYDPEHLGGGLAGFAPLAPARVLTFVAPNGLGALLDDLVAQVRRINETVLAGEFSSLRELHAATKRRPEPWRVAVLLGAGDLNRHERTQVERLLRTGAACGVHLIIHGFAVDPAPGIEFVTAAPGDEARMTSAGDLPVRLDPGPPPAVLTAACRQIAEAAAAGPAPVALDSLLPDPGDEWRESSATGLTAPLGDSPQGTRVMVTLSDYPPHALIAGPSGTGKTNFIYAWMGALAARYSPAELAFYLLDFKEGVSFARFAPGRRDQSWLPHVRLVGVNVNTDREFGLALLRFLGTELRRRADAAKQHEVTNLAELRAEDPQGVWPRIVAVVDEFQVLLAGRDAVTTEAVDLLEDLARRGRSQGIHLILASQDISGIEALWGRPALVAQFSLRIALPRARRVLAEQNAAADSLPRYHAVVNPDSGATEANQVVRVPAAGDREQWGALQHRLWRRLPAGELPPRLFDGDVQPRLADNPDFRALVADDSPAPVALLGETIDVMSRSARTVLRRAPGRNLAVLGTRVEEACAVLATAGRSLAAQFARDGARFSIACFDPDARAAAEALHARIPDCGWYDATNVDWLLEDAAAESTAAWPADRPHFIILYAADALPGGKTAGDQLRTVLRQGPERRLHVLGWWRGAGLLRDTLGGQGSRTDPIGAWVALDVHGSELAPYYPGAGAPNWYPRPWRALHFDRSVHRGAEVIIPYGVS

SEQ ID NO: 13955 - protein, 47 aa, Actinoplanes utahensis
MPVVEQLHQGRHLGGLRRRGRRVGVPLPGAFRLGRRFRRGGQQQLAS

SEQ ID NO: 13956 - protein, 338 aa, Actinoplanes utahensis
MRRWGRRTPPCRRPTSRSRIVSPRPGSPWRPRRTTRRCSDAMSVLQELGARLRAASDELPDGLVLVALEKLRSATELLNWVREESHQEIGVPQLGGATEHAERAAAALRLAEDAIEAYLAVLGLGGEPGARRGQEWREAMRPEEPRPPAAEPDAPPAEPEKLGPWWQERIAQLTGESAAKDQKRIEGTNSADLLRRVAAGVRSGDRARLGRELHGVTASTGLGLSAVTAPVLHRLAADLLGHEPRPEDVPRLRTAAEGRVRALLPGTSPSVLESLLDRICRVPPRGGQRPPGHPADNAVTASVLTGVLLARLGRDAEALDPNAPEPLRPHGDAGEARS

SEQ ID NO: 13957 - protein, 283 aa, Actinoplanes utahensis
MLISLSSPGTSTSGPHPGPTRVRWGQTPAADCQQRGKRDVDSRIRQKVDRSRLNFMPDSPKPAPGPLTPVFREPSFPEPAPASAKSPPQPPSPGSPTRPASAEAASRPVPPAAPAGPTCPESPFQGATSKAAVSGERTPQPTSPPAAVGAAAPAATSAPLTPLVIVDGANVVGSVPDGWWRDRAGAAARLRDNLAPIPAAGLGGLPGPVELILVVEGKARDIPAATAGVRIARAPGSGDDRIVDLVHAEQGSRHIVVITADRGLRDRVTALGAEVRGPSAVPR

SEQ ID NO: 13958 - protein, 867 aa, Actinoplanes utahensis
MSIGPMGPGGPGQWDDLFARFFGAAEPRRAAQRIDIARYMSNDARRVLADAARRAADLGAGDGLADLDTDHLLWAVLQQEPMKQTVRRAGADPQTLLAELEARLGDDASRTAAANRRADMGADRDGPEQVALTPAAKRALLDSLQISRAVGASYIGPEHILMALGLNTDSAAGRMLAGRLDPRAIPNPETPAGPPGGGQGGSRGGGRGGAAATPTLEQFGVDLTEVARRGEIDPVIGRADEIEQAVEILSRRTKNNPVLIGEAGVGKTAIVEGLAQRIVDGEVPLTLQDKRVVQLDLAGLVAGTRYRGDFEERLRKIIDEIQASGDGLIVFMDEIHTLVGAGGGGEGGGMDAGNMLKPALARGQLRVIGATTLDEYRKHIEKDAALARRFQPVLVGEPSVEDAVAILRGLRDNYEAHHQVRITDEALDAAAELSDRYVTDRFLPDKAIDLIDQAGARVRLRVKTPDKNLREQEWQLEQLSRDRDQAVHAENYEVASQLRDRINELKARIAGAGAGEDGVPRVTAADVAEVVSRATGIPVAQLTEAERDRLLRLEQHLHEHVIGQDDAVVAVAEAVRRSRAGLGDPDRPVGSFLFLGPTGVGKTELARSLAEALFGEADRMIRLDMSEFQERHTVSRLVGAPPGYVGYDEAGQLTEAVRRRPYSVVLLDEIEKAHPDVFNILLQVLDDGRLTDSQGRTVSFKNTVLIMTSNLGSDLISGTTRSVGFGGGENGRSPEDELRDRLDRRLKEQLRPEFINRIDEIIIFRQLETDQLRKITEMLLESTRRRLHGQDVTLELTTAAVDWLADRGYQPEFGARPLRRTIQRELDNRLSRMLLAADLAPGQTVTVDVRDGELALEVSSPAKVTAR

SEQ ID NO: 13959 - protein, 122 aa, Actinoplanes utahensis
MAREVTAGLPGPGDGLPGPGDMVLVTGEPGAGKSALLEDAGRHWDGAVFRTAGTAASAAEPLAAAGVLLPGWSPADAGAAAVRAGVGRIRELANGRPVLVVVDNANHVAPESAALLRRVAPV

SEQ ID NO: 13960 - protein, 430 aa, Actinoplanes utahensis
MALLGRALVARDRPVEAEEALRQTACAQVRALNRLWGLRRAEPPAVTAGPAAQAAALFVPGVPATAATAVDSADPVLAAADAALTTFRLVFAGAPERVVRENRELPRLWPSMRGAAAACRVHALVLTGRMTAARDTARAYYEAAVAGGEPAELAPLALQRGVCEWWAGSPRRAMPFLREAMALVDDRVPFPIRAYVRSEYAVCLAALGDGPQAYRLIAALRTEQSAGPGLDGQLRTTELQVMALTGRYVHAADLAVALAADLVATGRDTERVEALYLACRLRPSRAVAAGLAAAVDAADSPFFPLLARHAVALAEGDGAELIRCADAFERSGYPGLAAEACAGVDEARARRLVDSCDGFRPAWLPGRSGPATLTGREREVCELAAAGLSNASISQRLGISVRTVGNHLQRAYEKLHLTGRRDLGAALGLS

SEQ ID NO: 13961 - protein, 820 aa, Actinoplanes utahensis
MPDPLAGRLAAMLTGAPPPGGILLTGPPGIGRTRLLALVAQACSGRAVVLRPDDLPAPSAAPAPRRYAATTRALRRRAVDRPLVLAVDDLHLLPTDTVHLVEHLADAQVARLLATAPSSATCAAPVAPLLRRGTLRREPVPPLTAAGIAAVVTATLGGRADAVTVAELLRYSQGNPGLLRALLAAAPASGTLIRRAGTWRWSGRLPLDAVRDTVTALTGTPPTTAARYLAVAGPVPVPVLERLVDARTLEVLEEHEIIRLEPAGGEAVLRLSQPLYAALLREQLAPTDRSRLLRELAGAATAARADPVRTVDWLVRGGLAVAPGRRVAHARIALARGDADLAHRLAGAGDSVAHADVRAQALLVQGRVTDAEELFARIGAALPPSSRALRIVNLLWGLRRPQEAARVAREAFAAAQPPYPPELELAGEALALFTTVGGGVPVRSAPIRHPLLASTAAAVRGYRMIFTGRPGRIAAEHAADLVWPSMRGSAAACQVHALVLTGRLARAREVAAEYYDMAVTGGEPAEVAPLAMQRGVCEWWAGSPARALPFLREAAALLDDRVPYPVQAYVTSEYAVCLAAVGEGGRALRMLAGARAALPAGGRLRNHLLVGEIRVLALTGELSRAAEAAVRRAAGNLREGRLTSAAEGYYLAARLTGDPDVANRLAAVARRCDGELFELFAAHATALAGADRAGLREVADRFEAGGYSGFALEAVAAAAGLARRDGDDRGTAEGARVAARLTLACDGFRPAWLRFPPGPVRLGARERQACELAAAGLDNRQIAQRMGIAVRTVTNHLARGYAKLGVRGRQELAAALAPVS

SEQ ID NO: 13962 - protein, 981 aa, Actinoplanes utahensis
MDGVRGQQVQVVHGEHQRAVDRAAAQRAGRGGIPPRRRCCRRCRQIVRPEHHGPPGTGLCHQSEQPGPADPGRTGQQDATGRRRAGQHRRQPAGQRIRHRRDPFCSVVAGQRAGTRCPGATGRWRIEQRLLRWSGVAVHHHGQAPRSGRTESLTSRTPRRSRWGLLAAGILAVTLAGLGVPLALAGTGRPAATGPTRAGLLTTLDWENAADRALPPPGWQRQYCCAKSLQVVTDPVRDGGHAVQFTLDRGDPHVSSSTRSELSQPDRQPPGLDRWYGFSVHPARDWTVDRSSEIVSQWHQQSDNGSPPLALLTNRGDWKIDFRGEMIDLGTYRTVSWTDWVFHVVWRTDTSGVLQVWRDGSLVLDRKGRTHDDAAHSPYFKFGIYKWDWDGRPKVSDTSHRSLFYDALRIGDQRAGYAGVAPGGTVAVSPPPSAGSPGPSGTTPSDPAYSVVPATQKIARRSTVTGTPRAVLAGARNEFVSFQVVLAGGQRGVSVAPGRALSGSGGTIPNSAVTIYREDYYTTRQASAGGRAVGAWPDALIPAVDRLYGERRNAFPVDVPAGENRVAFVDVLVPAGQAAGGYDGSLTVTGSRGRADLPIHLDVHGFTLPATSSLRSLWSIGWSTGCDALHGSCDAWSSAANLQRAWRTNADFARLALDDRMTVANAQFQPPAPGSQRAAFDRYLLPLLRGTAQTQLPGARLTTVAVDPQQVRVWKAVADAEGFADRAVTYDAHDCDEPGSRAARWNACRAAVAGYKKAWPGLPNVMTAELSDVDRYDPRHVVTDIVTPVVDHFDDSSGDQPAAYRAFAARPGKQMWLYTSCDVSGCGGADEQDAELRLPWVDYTIDTQAAQNRAMGWLAYRYRATGELYYSTTQQLGTAWTDQWGFGGNGDGTLFYPGTTARIGGSTPIPLESLRMKMIRNGYQDYEYLRLADRAGRSAAARGVAARLYPSMHAAAPAPASIEAARAELITLIEGRPVAAR

SEQ ID NO: 13963 - protein, 319 aa, Actinoplanes utahensis
MNLELRHLKVVCAIAETGSVTKAASQLGLAQPALTAQLQRIERTLGGPLFDRDRRGARPTALGELVLSRARVLLPAMKGLQDEAARLAAGGGSTMSRYRMGAIGGPVFAHLLHRLSAARPEAQISTYASYYVDELATMVLNGKLDFAQVGVCGDALPSADYGLVWDTIAVDAVCVLMPEDHPQAKGAEVDLGELADEQWSAAAGDGCFETCFATACARAGFAPRRVLEADARACIDMVELGVALGLCQPTFRPPAGLTTRPLKGAPLRWRLILGWHPDSPAARSAPQVLELAREAYQDVINRNAGYVAWSQDHPTVAVA

SEQ ID NO: 13964 - protein, 188 aa, Actinoplanes utahensis
MSDVNLPPLPPVAGATSGRNVVDVLSEQHRQILSLTDRALTDESGRARDVLIATLSRHLSAEEQYLYPAVRTAVPDGDRIADRELAEDRELLVMMRDGVEMGTLRAAVRRHVEADSDELFPLLEQMVPIEDMIRLGNRVETAQEAAPTRPHPSTPVTPPWNKIVDPLLGVVDKLRDVATARTTYAKDL

SEQ ID NO: 13965 - protein, 434 aa, Actinoplanes utahensis
METSADEVVDLCRDLLRIDTTNTGDPRTTVGERVAAEYVATKLADAGIESRILESAPTRANLVARIPGADRSRGALLVHGHLDVVPADASEWSVDPFSGEIRDGYLWGRGAVDMKDFDAMVLAVVRDWQRTGYVPPRDIVLAYTADEEAGMEFGSQWLAQHHADVFEGCTEAIGEVGGYSYTVNDNLRLYLVQTAEKGLDWLRLHASGRPGHGSFIHDDNAVTALAEAVAAVGRHRFPVVVTPTVRAFLEQISDALQIDLDPDDPELAIAKLGPIANLIGATIRNTANPTRLAAGYKDNVIPGKASATIDCRTLPGQAESFLAELRDIIGPDVEIEHVHRQPAVETEFGGPLVEAMGAALRAEDPGARTVPYLMSGGTDAKAFSTLGIRCFGFAPLQLPPDLNFAALFHGIDERVPVEGLKFGVRVLDRLLRNS

SEQ ID NO: 13966 - protein, 222 aa, Actinoplanes utahensis
MSDQNAELDAALERVVEAARAHLAAVKAAAGRIDDDDVWQAYVDLNNASFAYDEKLLDAFGEVTPWDVESIDPDEADQRFLAGEAGADGGAGDAYPQVISVRQRRDYRVPSVSALLRVAENARKNAVPEDEEVGPVESVGEAVLELLQAGDGSLASLDVPELEPLDGLLTVTEVEAPLDLEAFDDADGSGPFAPAEGDQLVGRLDEHPFLPDEEDDHAGHNH

SEQ ID NO: 13967 - protein, 66 aa, Actinoplanes utahensis
MCPMDYEYAPLRLPSNVDRLTAAAQLAIAAEFSGWELARVQLFADGTRKVMLRRRLQATPQPGLSY

SEQ ID NO: 13968 - protein, 213 aa, Actinoplanes utahensis
MIGVLIVDDDALVRAGLRAILGAQPGITVTGEAADGAEVVPAALRRRPDVVLMDVRMPHLDGIQATRLLLDRFPVDAPRVLVVTTFANDEYVYTALQAGASGFLLKRARPEQIVEAVRVVARGDSLLFPAAIKSLAAAYARPDGGLRDAGLTGREAEVLTLMADGLSNAEIATRLFLGVETVKTHVGNILAKLGVRDRTQAVVTAYKSGFITP

SEQ ID NO: 13969 - protein, 370 aa, Actinoplanes utahensis
MPAIRTGRADAVMRRAVFLLLGAVLALPYTIAAGFVAHLVAADPRHWPRVAFAALVIGGLALVPAFLSGTRELEITAARALLGVGLPGHDRGHRMERETRLRSALWFGLHLVSGVLVGAVLLIVVPVGLIALTGGEAFGRGGWWWLAAAPVILAGAGYAVAGLGSLAATMAPILLGPSASEREHHLAERNRLARELHDSIGHALTAMTLQAGAARAVFDSDPEFARQALTAIEETGRAAAGELDAVLGLLRDEATGPTLTDLDQLLTGAVQASVTVGELPVAVSREAYRIVQESLTNAARHGTGPVTLRIRQEGDLMITVTNRRGAGDARPGGHGIAGMRERARLLGGRVTAGPDGENWRVTARLPVRAR

SEQ ID NO: 13970 - protein, 331 aa, Actinoplanes utahensis
MHQRPLGRSGLAVSRLALGTMTWGRDTDPDDAAEQMKLFLEAGGTLIDTADVYGNGDAEAVIGSLLDHLVPRDEVVIATKAGLTPHGWRARDGSRGNLLRSLDASLRRLGTDYVDLWQVHGYDGQTPFEETLSALDHAVTSGRVRYVGVSNFAAWQTARAATWQSAYPGRAPIVAAQMEYSLVERGIERELLPASAALGFGVLAWSPLGRGVLTGKYRNGRPLDSRAASEHYAPFVQTYLEPRSSSIVEAVVTAAGGLGVSPLEVALAWIRDRPGVTAPILGARTAGQLQGALRSEELVLPAEIARALEDVSAIDVGYPEREGAGDPHGAR

SEQ ID NO: 13971 - protein, 350 aa, Actinoplanes utahensis
MRLGLSLGYQTAWSTPADHLAMAREADRLGYAVVWAAEAYGSDTVSMLAWIAGQTERIDIGSAVLQIPARTPAMTAMTAATLDTLSGSRFRLGLGVSGPQVSEGWHGVRFAKPLARTREYVDIVKMALRRDRVQYDGEHYQLPLPGGAGKAIKLGFHPPRTEIPIYLAAVGPKNLELAGEVADGWLAIFFAPDAADDQLRHIAAGRARHGQGLAGFDVAPSVPVVVGDDISACADVVRWYAALYIGGMGSREQNFYNQLAVRMGYADAARRVQDLYLNRQVAEAAEAVPQEFIERTSIIGNKAQITKRIREYAAAGVGTLSISPYVGDLQSGLDTLRVVAEAYEESGVAR

SEQ ID NO: 13972 - protein, 200 aa, Actinoplanes utahensis
MTHQVHAFEPPERFVAGTVGEPGDRTFYLQARGGGRVISVALEKVQVSLLAEKLEELLLEANKRFGVTLPEAPLLAVHDNEPLDTPVDEEFRVGTLGLAFDVDTATVVIEAIEAGEAEVEISGDPLAEDDTEDEGDDEDEDDEPDDDLDRLRVRLTPEATRAFIDRARRVVAAGRPPCPLCGQPLDPGGHLCPRHNGYHR

SEQ ID NO: 13973 - protein, 294 aa, Actinoplanes utahensis
MPALRPAARPGRPPLPPAQRLPPVTAEPTEVLAEADALELLARGQIEIEGRLVDASNTTLRAEISLAGLTRRCVYKPVRGERPLWDFPDGTLAGREVSAYLVSQATGWDLVPPTILRDGPLGPGMLQLWIDEPEAAESLIGFVPAYDVPAGWFPVAAARDDDGDAYALAHADDPRLARLAVFDAVINNADRKGGHVLYPSTGTVHGVDHGVSFHVENKLRTVLWGWTGKPLPAEAAEVLGRLAAGLDGPLGEALEEHLTVAEVQHVRLRVKRLLRAGRFPKPPTDWPAIPWPPI

SEQ ID NO: 13974 - protein, 416 aa, Actinoplanes utahensis
MDAWTGHDVPTLPGDAPTLKLYDSARRSVHPVTAGGAAGGAATMYVCGITPYDATHLGHAATMIAFDLVNRLWRDAGHPVTYVQNVTDIDDPLLERAERDGEDWVVLAMRETALFREDMEALRIIPPAHYVGAVESIPAIAGHVRDLVANGAAYRLDDGTGDVYFDITAAPRWGYESNLSRPEMTELSAERGGDPGRPGKRDPLDPLLWRGARDGEPVWDGGDLGPGRPGWHIECATIALNLLGDTIDVQGGGSDLLYPHHECSAAHAEVLTGAAPFAGHYVHAGMIGLDGEKMSKSKGNLVFVSRLRADGIDPMAVRLGLLTGHYRADREWTDEVRKAGEQRLARWREAAAAPAGPSGTGLLGAVREALTDDLDAPAALAVVDAWVEAALSGAGDDTAGPALMAQTVDALLGVRL

SEQ ID NO: 13975 - protein, 96 aa, Actinoplanes utahensis
MRRPAMYLAGLFLATGASLALAAPASAAGTHCKKNYGAAAVHGYGHGAAYGHASGGGWYPGGYEYGYPVGYEDNDLYYQNNTQVGLININGGPFGF

SEQ ID NO: 13976 - protein, 236 aa, Actinoplanes utahensis
MAGLTGDPDSPAAAGDGGVRPIRVAIVDDDPLVRAGLRILVGGSPEIEVVAEAADGAEAIRAAQAHWPDVMLMDVRMPRVDGLVATRRIRERAGAPQVIVLTTFDVDDYVLEALRGGASGFLLKDTPPLEILAAVRTVAAGKAILSPGVIRRLIDHVADPAAGTRRARARGRLDDLTGREREVAVLVGQGCANAEIAARLGMSVPTAKGHVSRLLTKLDLNNRVQIALLVHDAELI

SEQ ID NO: 13977 - protein, 664 aa, Actinoplanes utahensis
MPVRLQPCGVLAQRGGQPPVGPHERPPAQRRRRDHPADHEVDPDVVGRALLQHEVQPAGGEVDRAQRQHQREAQPDRGGEQRHQDRSGGGHRHRPERQQRQQHGERMPPSEQQRGRAEHAERQVGRPRDRRPGAHRVAEQHHRRAVEQRERDRDGIGEPVPDGGARPTRIGYQQQEQHAAETRPRARPPAPCQSRGSHGSAGRCGGLLPAVTLAGMHDFRRLSVLLAPAAWGVVAARWTPHGPLTGAEALWSVLISAGVGFGAGRVLRSRWSIPLTPIWYVLCLEMSRVPPDPPHVSLLGVVTALTGRGVHGLLSVFPMALAAAYGCGFRRRRGRFLAGGGTLVLLLILVAVAIPARTPGIPGGVAELTTVPAAGHRLTVMIRGRDRTRPVLLFVPGAPGGSELGAMRAHLAGLEAHFVVATMERRGGGASYAALDPVSSVTPAGSVADILAVTDHLRSRFQRDRIVLLAHSGGSLLAVFAVRQHPEKYAAYVGTGQAVDVEASDQIFYDDILAWARATGKADVVRTLRRQGRPPYRSFWAYEPFLLHENEAYAQRAAPLEVSGPEYTLLQKAHTLNAIVDTWAALYPREQGIDLRRDVPELAVPAYFVQGGREMRGLSVLFADWYATLRAPVKRLVTIPGAGHRAMFEEPAAFTAALTTLLAP

SEQ ID NO: 13978 - protein, 263 aa, Actinoplanes utahensis
MTINPGAAEFPHRQIAAQLRERVRRGEWQPGERLPSIPGIAEMFGVAKQTVQRAVDQLRVEGVLITKPGSGTYVRGTRRRLNRLSRGRYGAHRGYHADLAARYRQQLVGVGREAAPPEVTDAFGVRDGTEMLVRRHIVRTDEATVELGASWFRVADTSGTTLERPEAFGRPLYQEAEEALGRRYTTATDTITARQPSREEAEILQIRPDTPVLHLLHVAFDETRKPIEVAQATWPGPMTTLTEEYRIPSPTPDPDPDPGLALA

SEQ ID NO: 13979 - protein, 504 aa, Actinoplanes utahensis
MQLGQQHLGPRRHQTHIDDVRHLPAPMPDPRRQPRPVQHPRIVDADRGDHQLGERPPPVQAHRRDPGPRQMHRPAPGRREVDAVHRRVQPAEPPVHRQQHHRRHDHRDDHRHLDVHHDARRTRTLAEHHRDQQEQQQQRGPAGGHHPQHRHVEHGARLDEGHRVVGRAEDLINVAGHSRIMLAYAPLHGENRSRPGRGHGAAAGCVSRPARRLCCMTEFDGLPLLRSPVAIAAFEGWNDAADASTAAVEHLEQVWEAREVTSIDPEDFYDFQVSRPTITMAEGETRKIEWPTTRFTVASPPGSDRDVVLIRGIEPSMRWRTFCESVLEICHSLEVNRIVLLGALLADVPYTRPLPISGSASAQEIAEKYNVVPTRYDGPTGIVGVLQEAATRAELDALSFWVHVPHYANNPPCPKATLALLSRIEDVLDLPVPMADLAQEADEWEKRVHAAAEQDAELGEYVRELEERVGDAGIQPLTGDEIASEFEKYLRRRGGSAGPTAGSW

SEQ ID NO: 13980 - protein, 109 aa, Actinoplanes utahensis
MTDRLSVIFAALADPTRRAILARLAEGEATVTELAEPFDISLPAISRHLKVLETAGLISRSRSAQWRSSRLEAAPLREATAWMERYRRFWDENFARLDAHLKRLQEEKP

SEQ ID NO: 13981 - protein, 146 aa, Actinoplanes utahensis
MTDLVITRIFDAPRDLVYRAFVDPDQVAAWFGPVGWSVPRDTVEIDARPGGRQAFTMVNDADPATSSAVNATFVEVVENELLVGEEDVSHIPAFGAEKLTLRLEFFDEEGGRTRLVLTQSPFPAAMETGAREGWGSSFTKLDKILA

SEQ ID NO: 13982 - protein, 1112 aa, Actinoplanes utahensis
MPRRVHDQGETNGDWDVGRRAGGGARGAGLEGLRQRRGAGHRAARGERRVRPGPVHGDHGPVGQRQVDVDALPGRPGHGRRGHRPRRRHGDQQARRQGADPAAPGPDRVHLPAVQPAADAERGGEHPAAAGHRRAQAGPAVVGRRDRHGRPAGPARPPPQPALRRPAAAGRLRPGADGPPRRDLRGRADRQSRLALRRRGPGLPARLGARARSDDRHGHPRPGRRRLCRPGGLPGRRRDRGRADRPDRRDGAGHHEAARQARRPGDALMLRATLKSLLARKLRLILSGLAVVLGVMFVSGSFVVTDTLDRTFDAIFADAFAATDVSVSAKPRVEVARMEGEQVAAPLPAATVDRIRTMAGVRSATGRVDADGARVIGGDGKVVTSSGPPRLGENWTGTDATMELRGGRGPQADDEIAVNATTAKLAGLRLGDRVGVLTLAPKKQFTLVGIWGYTGNRDSVGGAQEVAFTTPVAQRLMVGQAGAFTSVTVQAADGVTPDALRDRVAAALGDGYQVKTGRQLADESASSIKEGLKFFNRILLGFAGVALFVGIFLILNTFSIIVAQRTRELALLRAMGASRRQVIGSVLIEAVMIGLIASILGLAAGVGVGAALAGLFGRFADMTLAAIGVPLSAVLSAFTVGLLVTVVAAVLPALRASRIAPVAAMHQVSIPDRPLTRISVFGGVVLSAGAAMLGTGLFVSTSAPVTLWLILGGVLVSFIGVALLTPLLSRPVISVLGRIFAWSVPGRLGRLNSGRNPRRTAITAAALMVGIALVTGVTVVMDSAKSSLRAEAATVLKAQIMISGDQSGSRPPTYDQSVLQKITAIGGVRAAAGLWNDVASVDGKRQYVAGTTDLSRLAQAYGTTATALADDQIAVSRSTATDEHWPTGQRVTIQNSRGDPHTYTVTRIFADDTLPGSIILPGSRLADFGITQPVVGFVRLDDGVAVSSVLPQVKQLLADSPEVSATDAATFVDGQAAQFDQIITMIQILLGLAILIAVLGVVNTLALSVLERTRELGLLRAVGLGRAQTMRMITVEAVVISVFGALLGVAVGAGMGSAVARALRDDGITTIVLPWGRMGTYLVLAALVGVIAAVVPAIRAARLNVLGAIAHD

SEQ ID NO: 13983 - protein, 211 aa, Actinoplanes utahensis
MLFDMDGTLVDSEKLWGVALEDLAVRAGGQLSERARLAMVGTSMPVSMAIFRADLGQPDRPAGPDVAWLTDRVAELFAAGLDWRPGARELLHAVRAAGIPTALVTSTSRRLAEIALDTLGAFDVTVCGDEVDSPKPDPEPYLTAATRLGVPIASCVVIEDSPSGVTSAVAAGAVVVAVPSDVTLPVIAGVHLRTSLLEVDLGGLAALIPRV

SEQ ID NO: 13984 - protein, 238 aa, Actinoplanes utahensis
MPDHAPSDARRGPGIRPLRLLLADSSALHRAGLRAAVVAAPGDVELIVAGEAGDGAEALELARRLSPDVLVADAALPRRGPAALARAVAAARLPVRTLVLTEHDTDDELIELLGAGVAGYLCKDAPPEELFAAIRAVAAGGAVITPRVLARALPRFVAATTAPGPAVTADLRVLTGREREVLRHVARGHTNAEIAEALRVSETTVKTHVGHMLGKLRLRDRTQAVVLAYESGLVTPGG

SEQ ID NO: 13985 - protein, 369 aa, Actinoplanes utahensis
MSPAFSSYPCPSLAGMTAFSPPQPRPGAPAPASPATSAGRPGLDDRPAGPSLSPSRAADFKTCPLLFRFRTIDKLPEQPSADQVRGTLVHAVLERLFDLPAAERTPEAAAALVAPEWERLVGHEPELTALFAAEPPAPAVAHATESPALVRDPAAIAAEVDAAGQIALVDAPAGAAEAARLAAFLSGARDLLAGYFAVEDPQRLEPAERETLISTMIGDDELLIRGYIDRLDVSPAGDLRVVDYKTGGAPREAFEGRALFQLKFYALVLWRTRGVVPRVLRLLYLKDAEVLDYSPDAGELERFERTLIALSHAVERARRDQDFRPKPSRLCGWCSHQARCPEFGGTPPPFPTLPAAGLPTDAEPDRLAS

SEQ ID NO: 13986 - protein, 383 aa, Actinoplanes utahensis
MGDSATRRPPAAPGGRPVGRVLGIPVHANGSMLLLALLVTVVYGNYARDELGLAQPWAYLIGLGFVACLLGSVLLHELGHALIARRNGIGVRRITLELLSGWTEMERDAPSPRVDAAVSLAGPLVSLLLGGVATGAALVLPEDTVPGQIAFQLAVSNVLVAVFNVLPGLPLDGGRALRAGMWALLKDRNRATVVAGWAGRVIAFGTAVAVLVLFELGLLTLFGMLFVLLVTLTLWHGAGQSIRLGRMTGRFPLLDLGVLARPLLTVPAGTPLGEAQRRRAEDPRPDVVLAVADGGGNLTALVDPVAAERVPVDRRPWVSVESVARSRDALTSLSVELTGEQVVRALQAHPGAQYLVTAGEDVIGVLRVADVAAVLEPRRAQRT

SEQ ID NO: 13987 - protein, 306 aa, Actinoplanes utahensis
MTTIPAHRGPFRPGDRVQLTDPKGRMHTIVLEPGKAFHTHRGALEHDQLIGLADGSVIAATSGTQYLALRPLLSDYVLSMPRGAQVIYPKDAAQIVAMGDVFPGAKVLEAGAGSGALTCSLLRAVGESGEVHSYELRPDFAAIARKNVEAFFGGPHPAWHLHEGDVAGNEIGGFDRIVLDMLTPWEALDMVERSLIPGGVFIGYVATTPQLSELVEALRERGGWTEPRAWESLIRDWHAEGLAVRPDHRMIAHTAFLVSSRKLAPGVTAPARRRKPSKGAEAYALRRAAMAALAAESKESADTSGE

SEQ ID NO: 13988 - protein, 196 aa, Actinoplanes utahensis
MSSPPFGGSNEMPAVFPDWSPYPDLDSAARAYLRDPEVALEALFGVLRGASVLCFTLERFVNEVNGVWQEVVVCDGSRLVLWHGEDVAPGDGPAGSMTSSLRVVPLSTITEVGCRRRLTRTSTGQARVDSIDVYLLLSSVDDALPPPGLAEEEGRAPLRHDALRFGKTLDDGGPGQIARLEEFSRVVASLVGRPTL

SEQ ID NO: 13989 - protein, 95 aa, Actinoplanes utahensis
MSADTDELQVWIDQDLCTGDGLCVQYAPEVFELDIDGLAYVKSDSGALLQNPGVRTGVPRNLILEVIDSAKECPGDCIHVVRTADDVEVAGPDAA

SEQ ID NO: 13990 - protein, 593 aa, Actinoplanes utahensis
MARSDEADSRAARWEKEANDLSSQVAFLQEELALVRRKLTESPRHVRQLEERLAATQAQLSRVTENNERLVATLKEARAQIVTLKEEIDRLAQPPSGYGVFLSAHEDGTVDVFTGGRKLRVAVSPSLAADELQRGQEVLLNDALNVVDAFGFERTGEVVLLKEVLDNPGGGTADRALVVSHADEERIVFLAESLEIAKLRAGDSLMIEPRSAYAYERIPKSEVEELVLEEVPDVDYTDIGGLHSQIEQIRDAVELPFLHADLFREHQLRPPKGILLYGPPGCGKTLIAKAVANSLAKKIAERRGEEKHTSYFLNIKGPELLNKYVGETERHIRLVFQRAREKAGEGTPVIVFFDEMDSIFRTRGSGVSSDVENTIVPQLLSEIDGVEGLENVIVIGASNREDMIDPAILRPGRLDVKIKIERPDAEAAKDIFAKYILSDLPLSEDDLGEHGGNREATVAAMIEAVVLRMYTESEENRFLEVTYANGDKEVLYFKDFNSGAMIQNIVDRGKKMAIKEFLTSGTKGLRLQHLLDSCVDEFRENEDLPNTTNPDDWARISGKKGERIVYIRTLVSGGKGTEAGRSIETASNTGQYL

SEQ ID NO: 13991 - protein, 424 aa, Actinoplanes utahensis
MTRSRLTWLDALRGFAAAVVALFHLSPSVIGLDRHAAMQQHFDLGRYGVLLFFLVSGYVIPMSLERHGSLRRFWIGRVFRIYPAYLLAIGAGLLVAGAGLQELHGSLYSNTFASVLGHATMMQDLLGLRGVVRPIWTLAYEMVFYLIVAGLFVWGRQRASAWWAGGLALLALVAGRRLPDGVFAADFHDRRITAVVLTVILVASIAAYLSGARPVMLAAGLVGVAMVLLPMLNGQPTRYATPGASSTAILLLAVMFAGTVIYRAQHRELHRWVAGATLTLVLVVQAVNQWLLDGTQLVRNISVAGAVAGTFAVAFLMRHRAVPGFLTWLGVVSYSVYLLHMPVLAVVTRLLNGHPLPLFAAFVVATLAAAWTSYHLVELPGQELGRRVQRRLDALLGPDTPRTATTTEGGTPSTGSFGMRHESV

SEQ ID NO: 13992 - protein, 505 aa, Actinoplanes utahensis
MSVRRIMGTEVEYGISVPGQPGANPMVTSSQVVNAYGARPELNRGQRARWDYEEESPLRDARGFTYSGAAYDPAEALADEDLGLANVILTNGARLYVDHAHPEYSTPECTNPLDVVKWDKAGERVMAEASRRAATIPGAHRIQLYKNNTDNKGASYGSHENYLMRRQTAFADIVAHLTPFFVTRQIFCGVGRVGLGQDGSGAGFQISSRADFFEVEVGLETTLKRPIINTRDEPHADADKYRRLHVIIGDANLSEIASYLKMGTTALVLNMIEEKVFTGELGIADPVSELRAVSHDPTLKHLMRLRDGRRLTALDLQWAYYERAKAFVDERYGADADEQTTDVLNRWEDALDKLGRDPMLCSDTLDWVAKLRLLEGYRDRENLTWASPKLQLVDLQYADVRPEKGLYHRLVARGSMKTLLDPDDTQRAMYDPPEDTRAYFRGRCLAQYASEVVAASWDSVIFDVGRESLVRVPMMEPERGTRKHVGSLFDTCESAKDLLEVITSR

SEQ ID NO: 13993 - protein, 71 aa, Actinoplanes utahensis
MATRDTGGQSQSGRGSSDSEIEDVTVEANPEVAERHAEITEDVDDLLDEIDSVLEENAEEFVRGYVQKGGQ

SEQ ID NO: 13994 - protein, 280 aa, Actinoplanes utahensis
MATGFDPSGRLPDIFLNTGTSSFTQFLSAAAPELLPGRRPLPPGLSAGDVAPHGTTIIAIATADGVVMAGDRRATMGNLIASRDIRKVHPADSYSLIGIAGTAGIGIELIRLFQVELEHYEKTEGAMLSLDGKANRLAAMVRGNLGAAMQGLAVVPLFAGFDLAPADSSRAGRIFSFDVAGGLYEETGYEAIGSGSLFAKSALKKKYRAGVSTEEAIRLAVEALYDAADDDTATGGPDLTRKIYPVVMTATANGTVRLSDEEITTVAEQVVSGRMENPGG

SEQ ID NO: 13995 - protein, 265 aa, Actinoplanes utahensis
MAMQFYASPEQVQRDRSEYARKGIARGRSAVVLSYEGGILLVAENITTLRKISEIYDRIAFAAVGRYNEFESLRRAGVRMADMTGLTYDRRDVTGRALANAYTQTLGAIFSETQKPYEVEICIAQVGATPEQDELYRIMYDGSALDEPGFMAMGGQAEAIANVLRERHDVAADLPTALALAAEALGSVGGENGATRTLGPKQLEVAVLDRRRVGRTFRRIADAALTTLLGHEAVPDADLGETDAAPPAPADSKPTESAASESTEG

SEQ ID NO: 13996 - protein, 452 aa, Actinoplanes utahensis
MERRIFGLETEYGVTCTYRGQRRLSPDEVARYLFRRVVSWGRSSNVFLRNGARLYLDVGSHPEYATPECDSVTDLVAHDRAGERILEGLLVDAEKRLHDEGIAGEIYLFKNNTDSAGNSYGCHENYLVSRHGEFGRLADVLIPFLVTRQLICGAGKVLQTPRGAVFCLSQRAEHIWEGVSSATTRSRPIINTRDEPHADAERYRRLHVIVGDSNMNEVTTLLKVGSADIVLRMIEAGVVMRDLSLENPIRAIREVSHDVTGRRKIRLANNKEVSALEIQQEYLAKATEFVERRGGDPVAKRVVELWGRVLNAIETENLDPVAREIDWVSKYRLIERYQAKHDIPMSHPRIAQLDLAYHDVRRGRGLYALMEKRKQVDRIANDLQIFEAKETPPQTTRARLRGEFIKHAQDKRRDFTVDWVHLKLNDQAQRTVLCKDPFRAYDERVERLIASM

SEQ ID NO: 13997 - protein, 31 aa, Actinoplanes utahensis
MGREGSAGRWAILAAAPATLVGSPVVPVGLR

SEQ ID NO: 13998 - protein, 64 aa, Actinoplanes utahensis
MTSINSGQPDPEDVRRLNRADRRRERIRQQVQQARHGRKLIPTWLMAAVLALFLAGWVYLIVTK

SEQ ID NO: 13999 - protein, 228 aa, Actinoplanes utahensis
MRDRPVCERLRAMTEILGPGIEDYLLAHSTPADELLRELAAETRASLPPDYAGMQVSADEGALLTMLVQLTGVDYAVEVGTFTGFSSICIARGLRPGGRLLACDVSAEWTRIAGGYWERAGLRDRIELRLGPAVETLRALPADPVIDFGFIDADKINYPAYYEELVTRLRPGGLLALDNVLRDGRVLHPTDPADRAIAQLNDRIVGDDRVSSVMLPVRDGVTLVRKRD

SEQ ID NO: 14000 - protein, 420 aa, Actinoplanes utahensis
MVVLRRRRVQQCDRHPGRQGQRGVVEPGGSADPFFLGLYPACAAGIALLIRRRDEWRNGTALVDAATITIGFGLLAWVFVIEPAHGDIQMDRLAYGTQVAYPIGDLLLIAMMTRLVRGRGARGPALAAMVAALGALLVGDSSWVIMDNLGGAEKWLGLLPWLGRALESVFVTAFALFAVAALDPGAGRLAEPAQERSARLGPGLLALLTGASLIAPGLLAGQLHSGSVKNGWSIVLCSTTLFLLVVVRMAGLVREVERQARQVRDLARSDELTGLPNRRAWNDELPRALERARRDHQPVVVAIVDLDHFKRFNDTYGHPAGDRLLKAASAAWHETLRKADLLARYGGEEFVVLLPGSDAAHGHGALSRMLAATPQGQTFSAGLAVWDGQETSDELLQRADQALYLAKERGRNRIEMPAAA

SEQ ID NO: 14001 - protein, 313 aa, Actinoplanes utahensis
MPGLIFAALIGPAIATSPEWIFGSIEPDTTTTLVQPKTTGSSDQSTATAQVPSRIRASTLAMNQAQARASAIPQVSGRTSDRERRSAGEPQGVAMSQTDAAERRRRRRRRFSGLAVPLSILLGSMLVWQSSESAYTTTSSTLNNTWTAVSVALTNSQVASAPFTVSVAVPDASASSITLAGFSPSSVRTGGQMCIMVDYQTGAPAHIRMRIDDNADALSAALEMVIDEGTGATNAACSGFTSNGTYVYGTGAASTAKVSGLPTTWGTSTAGEWTAATAAQLWYRVTWLLPSNALAATSGTSADFKFQWEAQPY

SEQ ID NO: 14002 - protein, 211 aa, Actinoplanes utahensis
MGGAALLMPGVRRSRPRHRRHLRWHRRWWPAAVLVIVTAAALPVTGAGYTGTTSTPVNTFTAGTVVVSASAPAGRVFAITNAIPGTVGTTCVITAYTGTAPATVKMYFTSVAGTLGAYLVAQVQSGTGAQTDCSDFGSSATLYNGSAPATGGPTLGPYLAAHTGWSSGDGAWAVSGPATRAWRFDLLLPNTAGDAAAGLGLTFTATWEAQT

SEQ ID NO: 14003 - protein, 769 aa, Actinoplanes utahensis
MPGGSMATWSRRRRVAAVLFAGTLLVAMPLAWRPVAAQYTATTAVPATVAASAGFPGLPQLVTDGGPLFYHRGEESQTGALSSTAVDSSGNGQDGAYANSTNGPSLWWPMDDGPAATRYRDLSGTTDTGKPTGTPMTVTNTTGPTGGAYMLGASTASCCAQATLSSVLSPFRADRDFTVALWVDIGDTAPAAGSRFSAFHMTNSSYRRSDVALLVDNSASCAMAPCWAFTMAKDPNSTTVTGWDTAYGSAAAVNTWTHLTAVFVAATGTMSLYVNGVAPPATATHTVPADAATDRNVGFGRYRTGAGTGNWAGYGGRNTGIGMIIGEARTWRRALSAAEVAELPVRATSRWTFDEATGTTPGYTTASASTGTPSVTGSSTAGVTAGAAAALTTGRTGNALTIATAGVNGYVQGPSAQVTTSGSFSVAAWVRLTDTSADRTIVSQNGVLGTAFTLGYDSTANRWRMRWWPSDAAVVTPKSTVSAAAPVLNQWTHVAGVYEAGKEIRLYVDGRSSGTATPATTAAWPSLGATQIGRRVVGGATAEGWQGQIDDLRVYNGYPVVSTTMRQLVGSVEVEETGGLAGTRPLHANTTAMAFGGSSSGGNGRFAAAVAGPAFTEECLIRVASGETGVIGGFADTDDQLDSTVTDRLMYVDTTGRVRFGVLGAGVPVTVVSAAAVDDGTWHHVLASVGAAGLKLYVDGVKVTGTAVTAAASTTGYWRWGGVAMLPLNGWPSAPSNPYLTGTIDEFAVYDRQLTDQEDLWRVYADYLE

SEQ ID NO: 14004 - protein, 217 aa, Actinoplanes utahensis
MAGVRGLPGVRRRRIAGLAVPLSILLGSVLVWRSSTSAYSATTSTPNNTWTAVSVTLTNSQVATAPFTVPVAVPDATASSITLAGFAPSSTRTGGQACIMVDYQTAAPAHIRMRIDDNADALSAALEMVIDEGTGATNAACAGFTANGTFVYGTGTASTAKVSGLPITWGTSAPGEWTTATAAQLWYRVTWLLPSNALAATSGTSADFRFVWEAQPY

SEQ ID NO: 14005 - protein, 359 aa, Actinoplanes utahensis
MVRWRSGTVSSVRRRWRGAIELDVLCDGGGVRALAYPELVGSPEPGDRVLLNVGALVMGLGTGGYALVVALPDRLPADPADDGTTRDAGHLVKARYTPLQPILLGVDEEASPHRAVLAAAESLEAMPVVTADLHSALPAILAGVRADRPDARVAYVMTDGGALPAWFSRTLDGLTGHLAGTVTTGQAFGGDLEASTVHTGLLAARHVLRADVTVVAQGPGNLGTGTTWGFSGVALGEAVNAIGVLGGRPVGSLRISDGDGRERHRGVSHHSLTAYGKVALIRADLPVPEGLPAALAASIAPLAERHRIVEVPTGGLDAALRASPVPLSTMGRGLDRDHAYFLAAAAAGRHAAALLGADQ

SEQ ID NO: 14006 - protein, 335 aa, Actinoplanes utahensis
MTIAPEPETAPTGLPDNEPQAATESVGTVLLALLANLVIAVAKLVAGLLSGSAAMLSEAAHSFADTVTEIFLYVALRRGGKPADEEHPFGYGKESYVWAFIASLFTFVGGAGFSIYHGISTIVSGADAGDYLWSYVVLAISFVAEGSSFLKARRQVREQSRRWNVSPQRFLRLTSDTTVKAVFFEDAAALIGLLLAAAGLALTQLTGSEVWDGSASVLIGALLLVVASVLARTNVSLLVGRAVPRRMHNQIAADLRSIPVVTGVPTLFTMQIGPGDILVAAKVDFDDEVPGRDIEAASDEAERRLRDRYPEIRYVFLDPTRGVPGRDHIDGGLDR

SEQ ID NO: 14007 - protein, 331 aa, Actinoplanes utahensis
MSRTRTERLVNLVICLLSTRRFLTAAQIALTVPGYEHDPSDPRDHEAFQRKFERDKAELRELGVPLETGTASIFDQEPGYRIAQREYALPDILLEPDEAAAVGIAARLWQHAGLAAAASSGLAKLRAAGVEVDPQATLGVEPVVTVDPAFGPLTAAARARRAVQFKYRVPAVDEPSVRRLEPWGVVCWRGRWYVVGHDRDRNAARCFRLSRIVGDVRAVGRPEAFTPPADADLISHVAHSTGPIARTGRATVTVRPGRAAGLRRLASEVTPGPDGDRLTISYGDPDWLASRIAGYGPDARADGPPELRDAVIQQLKELTTRYDRDVPAVAR

SEQ ID NO: 14008 - protein, 328 aa, Actinoplanes utahensis
MTAPRTPSADRLGRLLNLVPYLLARPGILIAEAADDLGVTAKQLREDLELLWVCGLPGYGPGDLIDMAFDGDRVTISHDAGIDKPLRLNQDEALALVVALRMLAETPGIGSRDAIERALAKIESAAGDLADAPVAVKLPANQEKLAKVRAAVDSGHALRLTYYTAARDETTERVVDPMRMLTVGTFAYLEAWCRRAEATRMFRIDRIDAFTELDEPARPPVEAVPHDVTHGVFQPGPELPLVTLRVGRGGRWITEYYPVEQVQREPGEWLVTMRVTDLVWARRFLVGRADVTVVGPPELVEQIRDAAHEALDQYAAPHSLAADRAPAG

SEQ ID NO: 14009 - protein, 80 aa, Actinoplanes utahensis
MWVWIAVGAIALIILVVTAARLLGRLPELRRAAGRLQRRQAEAMGLQAGAARLEQTLQGLQQRAERAQEHVERIKAGSGH

SEQ ID NO: 14010 - protein, 132 aa, Actinoplanes utahensis
MGALKPWHLILLVVVLVLLFGAKRLPDAARSLGRSLRIMKAETKGLIDENNNDNLAEKADAQYSRQPLQGDVQGGYPQQGYQQQPPPGYQQPQPGYQQPQPGYQPHPQPGFQQPQQPPAQPFVDPVQRTNDR

SEQ ID NO: 14011 - protein, 319 aa, Actinoplanes utahensis
MASLTLRRNKKPSKFEQAADGSMTLIEHVRELRNRLFIASIGIVLGLIVGFVISQWAFDILKAPYCALPSSINDRTGSCEFITLAVTDQLMLRLKISLWLGLVLGAPVWLYQLWAFVAPGLHRHERRWAYLFVALALPLFAAGVIMAYLVIGHSLAFIMKAGVLGQPTKLEVTSYVGFVMNMLMLFGCAFEFPLLLLMLNFTGVVTGKRLLSWWRAVVFLAFAFAAIATPDPGPFGMALLAACISALYFVAVGVAILNDRRKGRGKEIYEGLSDDEISALDEERVPVGASDPISAPTPVDAPTPVEAPRSIERRFDDMT

SEQ ID NO: 14012 - protein, 363 aa, Actinoplanes utahensis
MGAGLPQGLWGGCGASGWGLASAAVTSDFIAVLANARAGRGRHRGLLPGVLQALGGAGHAVRLLDADSGAGAERACHQAVAEGAVALVAVGGDGTVHRALQAVAGGGPRVGESAPPGAQSWGSANFGAAAAGAVDSGLVAAGAAARRVGFGVVAAGTGNDFAGAVGVPGNPIEAAREISAALEAGRAQSIDAVLTADAVGRQRWFCAVLAAGFDALVNERANRMAWPRGPRRYDLAIVLELARLRARAYTLELDGETLHRDAEIVAVGNTASYGGGMRIVPAADPSDGLLDVIWAGGLGRGGLSRLTPRLRQGTHVTDPRVHQRRARHVRVAAEGIVGYADGERLGPLPLDMKLVPGAIRLLR

SEQ ID NO: 14013 - protein, 64 aa, Actinoplanes utahensis
MNTVSGTANSMTSLATSVFGNARQAFKAMAEAATNQQFGADTAATAQATPGRSARRGTILDRYI

SEQ ID NO: 14014 - protein, 1200 aa, Actinoplanes utahensis
MGSRRSAAIGSSDATGEGERGAEAVVAARLGGRDDQGGAAGLDRAGVRRGVSDHQRAFRISAQHAAGAQEDRRVGFDPAHLETQRERVHQTVQPPVREQRADVEADVADHADLDPGVVQLAQGGLGVRIWQPAVGAQQPVVERVGKALDIGRHGGRQPGVGGPVTVRVEIAVGPVLGQLRRHPVRQRATGPARGDQPVGQDRGLTAVQRGAAGRGGRDDPGHRVLDLGERAVEVEQDGFHEPRGRGMFGGKRHSCTLPMTGRCPRAPIPCRTLSYPRTSLLFMTSPADRYAESKRRAARVATFPALDDFMLDVGFDLDDFQRESCEALERGNGVLVCAPTGAGKTVVGEFAVHLALRAGERKCFYTTPIKALSNQKFHDLVERYGPDKVGLLTGDNVINADAPVVVMTTEVLRNMLYSGSSQLKNLAYVVMDEVHYLADRFRGAVWEEVIIHLPASVTLVSLSATVSNYEEFADWLVTVRGETSVVVSEHRPVPLWQHMLVGRRMFDLFHDADAARKHDVHPELLRYTREMERRLELGERASGWNGRGGRGRRWQPPPRAEVVDRLERAGLLPAILFIFSRAGCDAAVQQCLGAGLRLTDPDERAEIRRIAQAKVASIPAEDLSVLGYWEWLDGLERGVAAHHAGMLPAFKEAVEECFVNGLVKAVFATETLALGINMPARCVVLERLVKFNGEAHVDLTPGEYTQLTGRAGRRGIDVEGHAVVLWSPEVDPRHVAGLASTRTYPLRSSFRPSYNMAVNLVGTVGADKSRELLESSFAQFQADRSVVGLARQVQRNVDTMQTYGADAACHHGDFDEYFGLRVAIADREKAMARQGVAQRRSAANDSLSKVRIGDVIRVPQGRHAGLAVVLEPAAGGFGEPRPMVLTQDRWAGRVSPAEFGGEVEVLARLRVPKNFNHRSPGARRDLAAQVSGTGLDRHPDRRRSRGRANPGEDAEIALLKVKLRQHPCHACPEREDHARWAERRHRLQRDTDALRDKVAGRTGSLARTFDQVCSVLTARGYLSHDGEVTEAGRTLGRIWSEADLLVAECLRQDVWAGLAPEELAAAVSMVLYESRREGEDRASVPKGPISEAVDACAKLWTEIATEEGEHGLSLTREPDPGFVWPMFRWARGEPLAKVLASGHNYDADMPAGDFVRWARQVLDLLGQIREAAVASPGVKETARKAISAVNRGVLAYQAGL

SEQ ID NO: 14015 - protein, 276 aa, Actinoplanes utahensis
MVAGSPHLIGWSGDARADAVLAVIDPETAVIEVTLCGPWDRQLSAQARAVLDKCLAEHPTGMIVDLHRLTDPRAVSAALWLTLCAQGAAMRPPIAIGVCLPASAPLARRLRRLGARDWLVMHASVQQAHTALAHRRPLIDRMQLALPPDPAAASLARALIGDACQGWDLPHLLERGRLVASELVVNAAEHAGTDIAMIVSSRGEGVTAALHLAVHDGDPALPQVRDPVPGPLGPSLTDRGLGLRIVGAAASAWGALPARGGKLVWAILRNRPEVPG

SEQ ID NO: 14016 - protein, 120 aa, Actinoplanes utahensis
MIGGRDEPRFAGAGVAGARTGDRLLIHLRGSLDAMSVTALQTQLYDLTRVHDVLGLAAPVRQIHIDLAEVDFCDAAGLRMLVAARCVADARDATCHLRNPQPHLRWLLRATRASDLFQVD

SEQ ID NO: 14017 - protein, 635 aa, Actinoplanes utahensis
MTAEAGSYRVGMVASQEHVTADLARGATLVGGGVAVRFWAPAARRVFVAFDGVLSYLPDPADELVQDPVTGDWTGWFPGVGAGTKYRFYVIGAGGEGFKRDPQARELELYGYPECDALVVDDDAYPWHDQGWTPPGAAELIVYQFHVGVFAAADPLGHDRRPHRTAKLLDAVQRVPYLAALGVTAVQPLPVVEFQGEWSLGYNGTDLFSPEMDYCVDPHALPPYLDAVNELLAATGAGPLKFEQLAGQVNQLKAFVDVCHRFGIAVLFDVVYNHAGGGLDPQSLDYIDMPAAPGPDNNAYFTGDGWAGGRVFAFGRPAVREFLTANALMFLRDYHADGLRFDEVTVIDANGGWGFCQELTGTLRAAKPAAVQIAEYWGEFRGLAVAPPPGGMGFDLAYADTLRDAVRAVLADRGAGVGRLVAGLHSPGWSYNCLENHDLVLDMDDHRAPRIATLADSADPRSWYARSRSRVATGLLLTAPGVPMLFMGQEFLEDTLWSDSPGRTDRLIWWDGALGADRHMVDFLRCTRDLVHLRRELPALRSAAVDVLHVDEDNRVVAMRRGDDVVVLLTFSESTLYDYRLNLPWAGRWREVFNSDYYDFFPNPMVAGNAGAVTAAPEVSLTVPANGMMILQADH

SEQ ID NO: 14018 - protein, 186 aa, Actinoplanes utahensis
MDLSGIRTPLLVMGTAQVVMVAVMTAAPVEMHVHHHGLATIGVVLSAHTLGMFALSPVTGRLADRLGARPVMAAGLVTVAAGPVLAAVGAPRVLAFLLLGYGWNLCLIGGSAVLATRVPEPLRARAEGTVDGMVWVAAAAGGLASTGLLTIGGYGLLAALAVAAIGPAGLSVVRLQNHHPVRRDGQ

SEQ ID NO: 14019 - protein, 154 aa, Actinoplanes utahensis
MAKSLFVAAAAMNTAMATASPVATLVVADRLGPAWGGVPSTAAITGTGVGALILARSVSRRGWRHGLLVAFCCAVAGGLLAAAARGPVPLSVALVLLGYGNAGALLARYAVAETHPARHRGTAMGLLVWAGAIGAVGGPLLLGVLHPATVVLAS

SEQ ID NO: 14020 - protein, 126 aa, Actinoplanes utahensis
MHRSRLFGMLVDTPATEAGAAVSFWTAALGGSARQDPDEPEYTRVADVVPGVAVVVQAVDDRPRIHLDIETDDVEAETARLLGFGAQLVEDRGGHRILRAPGGHLVCVVPVQSSPELFAGDSRVWS

SEQ ID NO: 14021 - protein, 587 aa, Actinoplanes utahensis
MTQTCTAPPAEHDLLTRLRRDEPASFGAMFLAVAERQPQAVAYLRPGDDGWQSQTWTQTARAVTEIAAGLLALGLHPEDRVAIASGTRVEWIEADFGVMCAGGATTTIYPSSSPDEVAHILTDSGSRFAIAENPAQLAKILFPGTPVERAVLIDGTAADPRVLTLAELRALGDPARVAEAVAAVRPDDLATLIYTSGTTGLPKGVRVAHRAWVYQGLAIQAMGIVRPDDVGYLWLPLSHAFGKALLSCQLSVGFPFAVDGDVSRVVQRLGEVRPTIMPAVPRIFEKVYAAVSAADGVQKRLLDWAVATAGRRRSGWRFRIADRLVLSRVRARFGGRMRYFISGAATLDPGIARWFGAIGLPIAEGYGLTESCATTVFNRPDRPEYGTVGMPLPGTEVRIAEDGEVLLRGPGMMQGYHGLDSGAALRDGWLHTGDIGEITERGSLRITDRKKDLIKTSNGKYVAPQTLESRFKAICPLAGQFLVHGENRRYVTALIDLDPDEMAKWAAANGLGDASHAEIAGSEKLRAALQECVDRLNGTLNPWETVKRFAVLDRHLSVESGELTASLKLRRRVIEDRFRPVLDGLYA

SEQ ID NO: 14022 - protein, 224 aa, Actinoplanes utahensis
MTRERRGKIGVTRRTQMGCPPVPDRIASGVVFTTPPSLPRGRHELARDQVVAAQREKMLIAATELLAGAGYRGFGVREICARAAVSRAAFYDNFADKDACIHTAYDRFIEVLMSRLAAGAVSIDGFVTTYLQVLDSDRVAARAFQVEMDALGRPARRRRRAAIERLAALIAGLRDAPGVPLNAHIGAIYALRQITSDALDAGGTPDLTALAPELTPWLTRMLKE

SEQ ID NO: 14023 - protein, 257 aa, Actinoplanes utahensis
METDLELAQRAALTGAAEALRHFAVIADLPRETKKDGSVVTLADRAVENAIRGVLTEARPQDAILGEEHGETASGNGRRWIIDPIDGTALFVRGDDRWLVLIALEVDGEVTTGVQIVPAQGLAWWAQRGAGAYRGRVAGGALVDAERIHVAAAHGRATGSRLGVVPLDWGREVAAPLVAVADERTWPIHPPLLVAQGDLDVAVQTGGQIWDFAASSVIIPEAGGVFRGLDGSPRPGAGPHVFASNPALLDEALRILH

SEQ ID NO: 14024 - protein, 204 aa, Actinoplanes utahensis
MVPMTTIDSISVGASDPTAAAAFYRAAFDLGDIVQVHRSDAPTTGFRGFAVSLVVAQPADVDLFAAAALHAGATALKPVTKGFWGYGGVVQAPDGAIWKLATSSKKNTAPATRQIEAMVLLLGVENVKATKQFYLEHGMTVAKSFGSKYVEFTAGSSPIKLALYTRRAAAKDVGVPAEGTGSHRIAINGDTGGFTDPDGFVWNV

SEQ ID NO: 14025 - protein, 62 aa, Actinoplanes utahensis
MRSGPGGSARPTTNAPASSARCCLLVLDNAGSEAQVYAGGPHGITDTRLNQDLLAFLNSYAA

SEQ ID NO: 14026 - protein, 212 aa, Actinoplanes utahensis
MTTYRCPNGHDSGESDYCDTCGALIGSAPADPPTLVDTAPRGELCPHCGTPRAGSARFCEDCGYDHTTGKVPQLTEVLPIPAAPAADWTATVVADPAYFAMNAVEGVSFPADTGERTITLTPPQVRIGRASSSKGTSPEIDLADTDPGVSHNHALLTLNIDGVWLVTDLGSTNGTYLNDEDQPLTAGQSRTLKDGDQVHVGVWTTFTLHAPE

SEQ ID NO: 14027 - protein, 421 aa, Actinoplanes utahensis
MSYSAEAFQNEYLAMGASEVNAIVTVTSSGGDGGRRSAEATEIIIVDASGSMQAEGRMAAARQAAKAAVNCLDDGVRFAIIAGVSTAQQLFPDPGQLAVATPQSRADALRAIDRLQASGGTAMGAWLLLAAQLFDQRPGDIKHAILLTDGDNGERYGYLESVLEQVGGRFVCDCRGVGTNWKVSELRKIATAMLGTVDIVARPEGLTAAFEQMITAAMGKTAADVQLKVWTPVNATVRFVKQVEPQVLDLTGKRSEDGPRAGRYPLGSWGQESRDYHVCIDVPPGKSGDEMLAARISVVEGDTVHAQSLVRAVWTEDTALSTRINRQVAHYTGQAELADAIQEGIAAREAGDDRTATLKFGRAAQLAHASGNSATEELLAKVVEIEDAATGTVRLRRKVNAADEMALDTQSTKTVRVGRSQ

SEQ ID NO: 14028 - protein, 415 aa, Actinoplanes utahensis
MILTECDSCAEGRASGAAFCEACGRPLTETAAVGDGAEPPNDKDDGGGTPVSPAAGPRRGRDCPHCAAAGAVDADGYCEECGLLAGRPRDHVEADGDTVAAAVSDRGRRHHRNEDAMWLAVGVEAADVVVCDGVSSSFDPDVASEAAARAAGDLLARAQHPLEPAQVAEAADAAGATGPVESVAAAGPADDDVPRAAIDPEAGGEPDPGMAIAEIVATAIQEAGQAVAALVGNGDPRRAASNPACTIVAAAVRGPHVGFGWVGDSRAYWVTAGGPAQQLTEDDSWARHVIAMGADPRVAMNDPKAHAITAWLGADAGPILPHLGAFTAQTPGHLVLCSDGLWNYLTDPADFGDAVRSALTLATGPRPLLEAARALVAYANSAGGADNITVAIVPVVPRSTADAEGDADITEPSEA

SEQ ID NO: 14029 - protein, 736 aa, Actinoplanes utahensis
MKCQRDGCGGTIEDGYCDNLRLAPVAGAPSVPAQRTPEKASRNTGTQSSSRTTGALSTRTGSSRRGSGRTGSSRRFGSGLVEIAPIARVDPASTIMADAQVPESKRYCAKCNNPVGRSRGDRPGRTSGFCPSCGEAFNFTPKLVKGDVVGGQYEVAGALAHGGLGWVYLAVDLNVSRRWVVLKGLLNSGDEDALAAALAEQRFLAEVEHPNIVKIYNFVEHDGAGYIVMEYVGGKSLKDMLKQRRDANHGDADPLPLDQALEFLIEIMPAFSYLHERGLIFCDFKPDNVIQSGDQMKLIDLGGVVHIDDQDAALYGTVGYQAPEMATDGPSVASDLYTIGRTLAVLTTDFRGYQTTFKESLPDRDSFDVYKQHESFYRLVDRATRRDPDERFVDAAEMQEQMLGVLRQVVAAQGTPKPAPSKVFTGELRTDLKSDAPRWQDLPTPLIDLADPAAVFLASITVTDPAEVLALLQHAPQETPEVRLRALRAEIDLGTRHGFFGDAMKARDSFAELHGDDWRLAWYDGLLALAVEDWTTARTRFEAVWAALPGELAPQLGFAFAEELAGRPGSAAWYYDVVSRTDPAYTTAAAGLARCRLAGGDRAGAVEAYQRVPGTSSAYAISQVGAVRALVRAHPVAQVDVQSLTDAAALIERLEVERAQLAELRAELLEQTLSSLRGGHQVPASVLGPARTGDTVEKEVRFALEDAYREMARAAHGAEKIRLVDLANAARPRTRT

SEQ ID NO: 14030 - protein, 150 aa, Actinoplanes utahensis
MDRAEREAIRARERVDGRFAADRIATVRAVNLRPDLAAVEALAAAGQWALISPRLARWSREAGERLAALAAVRHHNDRLLADRDELRGRLSAYQAKALRHGLGEHPRLTPLAERARTLLHTAPCELEQARRAVDAYQEMLTATIARDARS

SEQ ID NO: 14031 - protein, 190 aa, Actinoplanes utahensis
MAGPLRRGAEAAGGTVPMTAPSVAPADAELARLETAVEAMSRNLVELDQLPARQELDAATLTGRTAAEWADASVAMAALWDGFRMLSESIARAQSLRAQRRLSDSDRATYVHVVLGPSILLSTTTVPLAQRGLLGAGQVTTTCSPAELLAAMERSFSTAVDVATRASEAWQRLLPAAGEVADALQRALAS

SEQ ID NO: 14032 - protein, 436 aa, Actinoplanes utahensis
MTTTLAHRPTATAAYSPPAGRLARRVADLRHHSPGRLQLILAGLLTLGLLTGLVAGLTAHSASAGTADLGRRAQPLMVEAETIYSTLADADTTAAQAFLAGGLEPAGMTQRYDDDLGRAGAALTRAARLAPDDSDADRQVEALATGISRYAALVATARANNRQNLPIGASYLAAASQLNRETLQPQAQALFRVADRGLSRGYATARSSWWLILLLVLFVALGIALVAGQGYLSRTTRRTFNVPMVAATALFALLALTTGVLFTNQRAHLDDATRDGSAPVAALAEIRIAALTERADEALTLGSRGTVDKEADFAAVSGRVNFDDPRLGATSPGLLDTARRQHAAYVQEHGQVQKLNAGGDYDGAVKAALSDTSARAFTGLTDALDRSISERRAAFADEIDGAGAGLTLLTVLGPLLALAACALVFVGIRARLEEYR

SEQ ID NO: 14033 - protein, 549 aa, Actinoplanes utahensis
MPKRWFRREAGSCWDETAVTAPVTAPLEGIHRMLNLSILLEDSARRHPDRAAVVLGPQRLTYAQVEAAAGQVANMLVARGIQPGDRVALSCPNLPYFPIVYYGILKAGAVVVPLNVLLKGREITYHLKDSQATAYFCFEGTAELPMGVEGRAGFEGAADCEHFFLITADPAAASPIEGTETLGQALAGHGPTFETVLRAETDAAVILYTSGTTGQAKGAELSHSNLVLNALTCNRLFNSQPATDTHLLVLPLFHSFGSTVNMNAGFSVAATLVLLPRFEANAAVRLLQDENVTFFAGVPTMYWGLLNALSANEGVDVERIAANMRVAVSGGSSLPIEIIKAVRERFGVTILEGYGLSETSPVATFSDPDGEPRPGSIGIPIWGVEVKLIDAEWNTVTGVDEIGEIAIRGHNIMKGYYNRPEATAEVMRDGWFRSGDLARRDKDGFYYIVDRAKDMIIRGGFNVYPREIEEVLLTHEAVSLAAVIGVAHPSHGEEVKAYVILKPGASATEDELVAWSREQMASYKYPRIVKIVESLPMTATGKLLKRELD

SEQ ID NO: 14034 - protein, 400 aa, Actinoplanes utahensis
MEAVHVGRQPIFDAQGAVVAYELLFRGRMDDVASGRQDTYATSTVMINAFTEFGIAEVAGNRPCFINLTREFVTGRLPLPFGPEQVVLEVLETVTVDDEVIEGITQLTAAGYKIALDDFVWGSGHEQLLALASYVKLDLLDGDLSRLDEIVAACRRYPGIALVGERLETDEQIAIADRYGMELRQGYALSRPQVLSAPSMSPSRLRRLELVAALMSPDVPLEKITSIIVSDPALAMRVLRVSNSVAAGVVSRISSVRQAVMLVGLTRIRRWATLMVVDDVAEAPEEQLLTALTQARLCENLAQRFGADPGAAFVAGLVTGMARLMGFTPTAMAEHLPLTSDVSDALTHGTGRLGMVLGAVRAYEAGEPGSEDLAVPALDAMRWSTRTLTAAHRFNPKRRR

SEQ ID NO: 14035 - protein, 192 aa, Actinoplanes utahensis
MGFEERATAPVMSRRTIITLDLPGGVPSICRLRPTDPVTAERFVVRRELAPAHCGVPMMLRVRVLDAVDRPLPGAVLEIIHRGPLPTAPELSGAQVTDPHGYAEFKTVYPGWASDRPAGIDLVLYLAGSCDRGRLHFPAPVTAQVARLTAYRENPDPLPPPEPPAGFPNIVPRDRYDLAAGLLASINAVTDR

SEQ ID NO: 14036 - protein, 330 aa, Actinoplanes utahensis
MEHAVLVRSIYNHLVVRYRRPTKITTRCGSDSVPDMTFSIVARSADMFGVAVASRFLGVGAAVPAALADVGAVATQSYANLAYRPQALTLLSTGVPAEHTVRALVAGDDGPVGHRQVGVVGASGPGATYTGPACHPWAGGTAGDGYAIQGNMLAGPAVVADMEDTWLRSTGEARLAHRLVTALRAGDQAGGDRRGRQSAALLVVAKGRGYAGTGDVLADLRVDDHPDPVTELARLLAVHTLYFERPDPTTLLPLTGSLAAEVADRLRGAGRTEPDLDEALASWAGIENLEMRIVPGSIDPLVLAHLRAAAAADQAASARRSEPPGGATGR

SEQ ID NO: 14037 - protein, 162 aa, Actinoplanes utahensis
MTVRETIPDAEALTLTFVTEFDAPVERVWRVWSDPRRLERWWGPPTWPATFERLDFVPGGAARYHMTGPDGTKARGWWSITAIDEPYRLEYDDGFAGDDGEPLDADQPMHAVVTLERAGDRTRMTVVNRFADAAQFERLMTMGMAEGMGLALGQIDELLRAA

SEQ ID NO: 14038 - protein, 247 aa, Actinoplanes utahensis
MIAGRITAVVTPAGPRRWSPPAPSGHVGHPDCVNLVADHATRQTAPRHGVGDNPGMTGTNLRDRKREQNRVATVRAAWELFIERGYDHVTVSDICAAADIAPRTFHRYFAGKQDVVAEPVREMTGLVTDYVAGAPPEADDRAVMREAMTRLARHVVTNRELLAALRTVVQDSTHLRTCGLVIRTDTEPDIAGMLAARHPGADPADWRRRLLVACSTAAFRIWYEDFLPGELTDPMGHLRAVMDAAGT

SEQ ID NO: 14039 - protein, 201 aa, Actinoplanes utahensis
MQPARVDHGVVSGTFSLDGQTFDVDNNVWVVGDDTECVVIDAPHDVDAIMAIVGERRVTAIVCTHAHDDHVRVAPALRERTGAPILLHPAEAPLWKLTHGDAVTWDADLADGDRVQVAGTTLTVLHTPGHAPGAVCLHAPDLGCVFTGDTLFQGGPGATGRSYSDADLIVASIEARLFTLPGATVVHTGHGADTTIAAERA

SEQ ID NO: 14040 - protein, 369 aa, Actinoplanes utahensis
MRLWAKCGIAVGCLLATSAGFAGPVNTLGGLSATALGGLPAAAAQLRAGVIGALTEPIRGPLNILLIGIDPRDDHTAPLSDSMVVAHIPADRSGAYLFSLPRDLVVPIPAFAKSGSPAQRAKLNAAMALGSRIGEHRYSPAQGFELLTETIRNVTGIRFDAGAILNFGGFTTLVAAMGGVSVPVDETVVSEHRKPDGTSRDRLPQCPGHDDCHRPYIGVQKVYPKSDKPVHFQGWEALDYCRQRYGLPHSDYDRQRHQRQFVQALAKKMKRRILTDPAALPRLTATVGSSLTFIGNGHPIADWAAALGSLRTRDMTGIGLPGYPLFENGAYQGEQLPPTVTPFFAAVQRDRIAAFLRTHPGLVSLDARL

SEQ ID NO: 14041 - protein, 463 aa, Actinoplanes utahensis
MTATALRPPKAPLGNTPRWYADLGGVAAAISLLIVVALWVGNRGLQQIAGGGAEAMSAAGRLTGLIASDLLLLQVLLMARIPVVERAFGQDRLARWHRWTGFTSFWLMIVHIVTITLGYAASAHATAFAELWDMIWTYPGMLLATAGTLLLILVVVTSVRAARRRLRYESWHLLHLYAYLGVGLALPHQLWTGADFTASAAARLYWWTLYGVSAGAVLAYRIGLPAWRNHRHRLVVTRVVPEGPGLTSVYLSGRDLSGLPARAGQFFTWRFLDGPGWTRANPYSLSATPGGDQLRITVKNLGDSSSRVANLRPGTKVLVEGPYGKLTGETYTGGPVVLVACGIGVTPLLSLLGELPYRPGEATLIYRARSEAELAFRGELEWFAAHRGVRVVTLLGPRAGHPSWLPADVAAHGDVQALRQIAPQIAGSQVYVCGPEAWTAQVHAAARASGVAADRLHTELFSW

SEQ ID NO: 14042 - protein, 135 aa, Actinoplanes utahensis
MRRISLWMLSTVVGLVLLFSYRTSLGGGAVATAATVATAGGTGTGTAYDGSTASTRWGDVQVRITVDNGRITGVTVPVYPTGNGKDQEINAYALPKLVQETLTAQSAAIDAVSGATVTSGGYIESLQAALDAAHL

SEQ ID NO: 14043 - protein, 235 aa, Actinoplanes utahensis
MRILVVEDDAAVRDSLARTLRFEGYQVEIAGDGLQALDAVRAAEPDAVILDVSMPRMDGLEACRRMRADGLLLPVLMLTARDSVGDRVAGLDAGADDYLIKPFALQELLARVRALLRRSALTAPAGAAGATEAGELLVFSDVRLDPGTREVQRAGRQLRLTRTEFDILEAFLRHPRQVLTRAALFEQVWGYDFGEQSNSLHVYLGYLRRKLEAEGEPRLLHTVRGVGFVLREEPL

SEQ ID NO: 14044 - protein, 478 aa, Actinoplanes utahensis
MRRSGRWWRARTLHTRLALLVAAAVGAAVLFVAAGAWVAVREIQRHQADGQLADAAQQIAANPGQWLATESSRTRDLPTLPPPHGPGRGGHHGREIGTCWQILTAAGTASGGSRTTLPVTAAARQVAGGARTRPAKEQITLGPDSYVMLTVPLAGGGAVQVGMDQDPGENVLTAFAALLALGCLAGVGGAALLGRTVARAGLAPVDRLTEAVEHVAATQDLSRSIEVDGTDEIARLGRSVNAMLAAIDASRGAQRALVEDAGHELRTPLTSIRTNVELLLELERRPELAHRLPPEERAKLLADLDAQVQELATLTTELVELAREEATRETVEPVDLSEVVAAAVARVRIRAPGLTYDTDLAPSTVDGRPGELERMVVNVLDNAAKWSPAGAVVRVRLAGAEPGWTELTVTDSGPGIAEEDLPHVFDRFYRATAARSMPGSGLGLAIVAQTASQHGGTVIAAPADGGGTVVTIRLPAAA

SEQ ID NO: 14045 - protein, 396 aa, Actinoplanes utahensis
MADEIIGIVGAGIVGLAIGREITRRRPGTRVVVLEKESAVAQHQTGHNSGVVHAGIYYTPGSLKAQLCTRGRSLLKEYCQERQIPYDECGKLVVAVRADELGRLDDLEKRARENDVPGLRRVDPAGIREIEPHAAGLAALHSPETAITDFPAVARALAADIVAAGGEVRLNWPVTGLDRTERIEVRSGDRRLTADRLIICAGIQSDRVARLAGDRAEPIIIPFRGEYMRVTSAKADMVRGMIYPVPDPRYPFLGVHFTRRVTGVVEVGPNAVLATAREGYRRSAVSVPDLAALAAWPGAWRMARQHWRTGIKEVRGSVSKTRYMAEAMRYVPEIGPADVVRAGAGVRAQALDRDGSLVDDFRIHRMGAVTAVRNAPSPAATSCMAIAEHVVDAIFA

SEQ ID NO: 14046 - protein, 185 aa, Actinoplanes utahensis
MSDDAGVTAEATEPTVEPATPGTPETPEAPDRTWIRQSLVAGAIVVSILLGAAVATGVWLVRGLPGQPVQHFSVSVYLKDDVTAEQKAAIEAALPAFQPVGPITFIDRDKAWRHAKELFKDDPDFLDSVNPDVMPQSFSLETKGRLFDCTGYATVRHLPGVQKVQVVQAPVNHYIASITCDAEYR

SEQ ID NO: 14047 - protein, 279 aa, Actinoplanes utahensis
MSRLRGTGMTLAYDKRVIAEQLSVAIPDGSFTVVIGPNACGKSTLLRALSRLLKPTTGTVLLDGADVQSLPTRTVARVLGLLPQSATAPDGISVAELVSRGRYPHQGLLRRWSAEDDRIVAESMAATGVADLATRSVDELSGGQRQRVWIAMALAQQTPLLLLDEPTTFLDVAHQLEILDLCADLHERQGRTLVAVLHDLNHAARYATHLIAMRAGRVVKAGPPAQVLTASLVEEVFDLPCRVIDDPETGTPLVVPAARRRTAVRPRPPGVRGNDDLRC

SEQ ID NO: 14048 - protein, 325 aa, Actinoplanes utahensis
MRTRLVPLVAIVLMTAVAVLTLGTGDYPIAPADVVKTLAGQGSAAQAFIIGELRLPRVITAILVGMSLAAGGAIFQSITRNPLGSPDILGITSGAGAAALTVVILGGGSTALALAAVAGGVATALLIQLIGGRRGLRGYRLILIGIGMTAILNGVIGWLLTRGQQMENARAMLWLTGSFDGRGWTQALPLLGVLLVAVPILALAGGPGLRMLEMGDDLAAGLGVPVRRLRNGALLTASIIVACATAAAGPVNFVALIAPNIARRLTRAPGPGLLPSMAVGALLTVGADWLAMHSGHALPVGVVTGALGGGYLIWLLIAARRAGRI

SEQ ID NO: 14049 - protein, 306 aa, Actinoplanes utahensis
MLVLGIGFGARFLTPGEVWAGLIDPASPYYRIVHQMRLPRTLSGLIVGLALGLAGAIMQALTRNPLADPGLLGINAGASAAVATAAAFLGVASFSGYVWFALAGAAVVTALVYAVGGGRSATPARLALAGAALNAALYSYVSAVLLSDTASIQKVRFWTVGSLASADFDTLRRLIAFIAAGVVLALAAARPLNALALGDDAARALGARPGVIRAMVIAAVTLLCGAATAACGPIVFVGLLVPHLVRPLTGPDLRWMLPYAAVLAPVLLVGADVLGRVVGSPGELQVGVVTAVLGGPLFLYLVRVAR

SEQ ID NO: 14050 - protein, 351 aa, Actinoplanes utahensis
MLRPSGRAAALPKDVTMPVSSLPLSRRGLLAAGGVAALGAVLTACGTKEDATAGPAGQAAAGPWTFTDDQPKALQAAKTPSRIVAFTGVAAALADLGLQDRIVGVFGEARTQAGDLDVTKVQVIGDAWGEFSVEKYAALTPDLLVTHEFDPGAYWYVPDESKDKILAVAPSALINVGRVPLNKPIERYADLARSLGADLTAPKVTEAKARFEKAAQDLGDAAKASGGIKVLFGSGSADIFYVSSADVSSDLMYFKSLGVDLIVPEVEGKDYYESLSWENADKYQADIIFLDARTGTLQPKDLAAKPAWNALPAVKANQVFPWQAVPIYSWNHAAPLVEAITAAIRKSKKLG

SEQ ID NO: 14051 - protein, 335 aa, Actinoplanes utahensis
MITVTGEAQLEAWRSRALPPVERLAGGIWSVPVPIPQSPLRYTLSYLIPGDDGLVVVDPGWDSAEGWAALHAGLSAAGATTGDVRGVVVTHVHSDHHGLSKRLQDLGAWVAMHPAERDALHPGGSPADWLRAHHVPEDEIAALAGTIGQHRLSEPAQPDVLLQDGDPIPLAGRTVTTVWTPGHTPGHICLLEPAAGVLLTGDHLLPRISPNIGLQRPGSSPLESFLESLDRVAKHDELEAFPAHEYRFRGIAARSRQLREHHEARCDEIVATVAALGAPTIWTLAASLTWSRPWAEIGPMRVGAVAETMAHVRYLADRGALHWSGETVSPASSTS

SEQ ID NO: 14052 - protein, 202 aa, Actinoplanes utahensis
MSATPQAATGRPRDPAVDERITRAAAEVFGENGWHRFTIDTVARRAGVGKASVYLRWPNKEALLAAALTARLNGIEDIDTGTVRDDLISLARQIQRSYLGESGRAALQLRVDAQRVPEVRDHLHRLQESQVLAARAIVRRAIARGELRSDTSVTLLLDCVCGGVMNHVLATPPQLRDQVAAGADEYAAALVDFVLSAARPAP

SEQ ID NO: 14053 - protein, 2105 aa, Actinoplanes utahensis
MSSSHRGNTYRRRTWPSRRMLAYGTVLLVTAAGLAAPWSASPAVAAPASPARPDKAERPDKVSAFLAAQATGRDILVTGETSATTLTYVRPDGSLRSEVTPAPVRVRQRDGSWAGVDYHLVKVGGGYAPRVSPANVVFSAGGDGPAVTLDNGRRAVDLRWAKSLPAPAISGNSAVYQLTDNEQLVLTATSDGFEQSLKLLARPAGVPKLRLGFDATGMTMVADGTGGYRFVATESGRATSTVLYTMPTPRMYSSQVINEEHTQIQRVPVTLATDTDGTQYVDLSAGKSFLDDPATVYPVWIDPAVSSVSRYGDTYVTEADSDSHVSDSDLRIGNSTNGNIRRSLVRFNTTGSIPAGAHVTSAALKLWTNYSGTCSARSMAAYPITENYTMTSATWANQPSYSTSSAYSASSSFAFGNEDLGCANGTGTVPVTNMVQAWVSGKLADYGMLLKAGSETDTTYTKYFCAMNVDATGATSCTSSAHYPTMSVVYNTYPGTPGSVTFSPRVAGTTSDSNTGGARIFSTSLTPKFSAKLANADGGKVTLQVKLSHDVNNTGEGTGEITTLTSTAVTPGSTATVAVPAGVLTNNTHVMYQTRARVTNGAGGYDYSAWTPASLSATTATKFLLNTDTPAEPSIACGAYPAGTWTAQVGATTSCAIDTTAADGAGYYWGLDDPSAPNLAADSSNTGAAVTVSTIATTPGWHTLYARSRDTALHLSTGTTAYIFGVGAGGVLSPEPGASTAKGVALSASTGSAYTGVTYQWAAGTTGTTWTDLPTADVTPAGSSTPITAWPLTGTAAGPLVSFTGYNWNVAATLAAAGEPDGALRVRARFTTASGSTGYSAERVFTLAVTTFGQNAATSDLGPGTVSLTTGDFQVSAGDSSVGGLSIGRTATSLVPAAASNGPSGVFGPGWRASLPGADAGAGDAVLLDNSVSGSVTLQHADGTEAVYVKQSSGAYRGVGGANDGTVLTRSTSITNPADPADTTAYTGWQLTDAGGTVTTWTRTSTGIWTVAWIDEPGKEGETAYARDGNGRVTTILAPAPTGVTCTTGSFNAAGCSALRLTYATGTTASSTDEAGWGTYNGLLSGVSWTGYDPAAATMVTKPVAAYLYDSTGHLRAAWDPRDTTPLKIRYGYDAAGRIATITPAGLNPWTLSYDNRGRLAGVSRNDPANGVATRAVAYDLPVSGLGGAPDVSGTAAAGWGQTTDLAYSGAAVFPASHVPAADKATGAYAPAAADWPYGSVTYADVDGRVVDVAGYGASAWQIDATRYDTDGDEIWSLTAGNRAQALSPTADTDPYVASQSSSAARANLLASTSVYDADGVDLLSTLGPAHPARLADGTVASIRLRTDYTYDAGAPTTDAYHLVTRTVTGPVALDGSVTTAADTRTTVTGYNPIDGSSATGNTSGWVLHTPTTETTWLGSSASAADLTRQTRYDAAGRVVESRLPGGSATDADTTVTTYYTTGSNTTYPACGGKPSWAGMVCRTDPGGAPSTGYAVPSKAYTYNLYGQPLTVTETSGAVVRTTTTGYDGVGRSTGTSLSVTGLPGSAAVTATGRTYDPATGLPATTTQGSAVLTSTYDAIGRQASYTDADGAVSTYGYDLDGHTTRFVDVRTTTYTYDSGTEHRGLLVGMNAGMDNAPSTFTAGYDAAGKMTVQSYPNGTTAAYHFDNTGQPTSLSYQLPTYSGGTAGTIEFSTVANPDGQTVHAQSPLSAQDYTYDNAKRLTEVQDTTDGSCVTRRYGFDKQSDRTSLASYAATADGGCQTTTAAGTSTSTYDTANRITTAGYTYDQLGRTLTVPAAGLASGSSALTVAYQDTDMPVSMTQGTAGKTFTLDPARRYRQVVDTTSGAETRRTVNHYANNSDSPSYLTVSADGGATAAWARNIIGLDGRLAAVHGSDAVATLELTNLHGDVVATVPDQVPTATDTTGASATAYFESTEYGTARDGTLNGRYNWLGGAQRSTDAVASLVLMGARLYNPASGRFLTVDPVAGGNQNAYDYPSDPINSFDVTGLKRHGGFSRHWWGISLYLTEWATNRLMRGFAAGSGVAWAAAELTSWTGIGGVTGGAIAALLAAMGGGIWLCDWNDRGVGFHYTYPWYGGAFWCWAR

SEQ ID NO: 14054 - protein, 127 aa, Actinoplanes utahensis
MHRWRRPAIVTTVDSLGPGADYMYAMTAIGLFLMPWVMAGLGVLSGAGRTARSRAAGRLTALLLLIWFVASFVIAQWDTDQGYFLADVVGGGFCVLTWLLVPWLVSFLVTRWRRARRRSGGSPGAAA

SEQ ID NO: 14055 - protein, 115 aa, Actinoplanes utahensis
MDAETLKKYCLDKPGAWPDQPWEGDVVAKVGPKIFAFLGSTGETVGVKCGKGRDLADEWLARYPEDATASAYIGRHGWNTLRLRGAIPAEEILEAVDASYDAVVASLPKKDRPTG

SEQ ID NO: 14056 - protein, 210 aa, Actinoplanes utahensis
MIDASEQINRTRRTLAGRTLQAGEARVLTISQVYDTGLDDLWEVVTTAERLERWFLPISGELREGGKYQFEGQAGGTITRCDRPHVLALTWEFAGQVSWVEIRLTPEGDERTRFTLEHTAPVDEHWDRFGPGAVGIGWEMGLLGLSMHVAAPDAPRDNAAIAAWTASEDAQRFMRLSGQAWAEADIAAGTDAAEARARAANTYAAYTGVE

SEQ ID NO: 14057 - protein, 199 aa, Actinoplanes utahensis
MHAFDVLGDPVRRRIMEVLADGEQTSGAVTAVIRAEFGISQPAVSQHLKVLRDNGFATVRPDGARRLYAVDDTALRQADEWLGRFRRFWTPHLAAMATEVARGKRLRRLAAPDDQPGTTPDQRLRRPATPEDQPGADRLRRPATPEDQPGADRLRRPATPEDQPGADPGRRRAAVRRPPAPAASDRGGPGASDDYQELR

SEQ ID NO: 14058 - protein, 483 aa, Actinoplanes utahensis
MKRSLKLILASALAAATVGTVAFFALPASAEAASFTVTNSWSTGYQGEVTVSNPASSKINTWKVQLTLPAGSTIGQAWNATLATGGQTFTFTPAGWNGTIAGGSATSFGFVVTGTGRPTSCTVNGQACTGLTGAPSATATSAPGKTPTSAPATATGAPKPSATTASPTRTATAGGTPLAANGQLKVCGAGLCNQNGKKIQLRGVSSHGIHWFPGCYTGAAMDALATDWNADLFRIAMYVQEGGYESDPTGQTAKVNSLVDMAEAHGMYALIDFHVLNPGDPNLNLARAKEFFAKVAARNAAKKNVIYEIANEPNGVSWAGIKSYAEQVIPVIRANDPDGIVIIGTRGWSSLGVSEGSSSAEIIDNPVNATNIMYAFHFYAASHKDDYRAEVQKAAASIPLFVTEFGTVSASGDGAVDTAGTTAWLDLLDKLKISYANWNFGDKAEGSSILKPGSCNAGAFSGTGALTPSGQLIRSRIRTPDDF

SEQ ID NO: 14059 - protein, 148 aa, Actinoplanes utahensis
MSDEEFIHTALVVAFTADSGHPRGLQHAIDEIYRLLHEAPAGHPDLVIGWGVLFDLLQEQAEQSGDLGDWDALVDAGGCMVLVAEPGTELAVRAWRRQWQALLLRHQATRDPADLRDAKVAATALAAAAAAVPPSPHQPRPRRLWRCD

SEQ ID NO: 14060 - protein, 30 aa, Actinoplanes utahensis
MAQEGGTELGELAPGIAVRLTLRPVPVALE

SEQ ID NO: 14061 - protein, 76 aa, Actinoplanes utahensis
MADFAGLSNRLPGTVQGDVIEVLGERLPLVAPHTGGIATALVRPESISIVPDPDGSGRVLTASFPRPIGRVTITSR

SEQ ID NO: 14062 - protein, 133 aa, Actinoplanes utahensis
MATESRHVAEHIDRPARDVYEYASEPANLAHWAPGLGGSVRLEDGRWLVDVPDGGVAEVVFVPRNDLGVLDHEVHLPDGAIVYVPLRVIADGDHSEIVFTVRRAVGMTDDMYDRDIAAVAADLGRLKQILESR

SEQ ID NO: 14063 - protein, 267 aa, Actinoplanes utahensis
MDEATTHIVTYYETRYEEATRLERRPQSRLERIRTLELLREVLPAAPARILDVGGGPGAYARELLADGHHVRLVDLVPAHVDQARAGHPPIDAVVGDARSLPEPDRSQDATLLLGPLYHLHDRADRIRAIREAIRVTRPGGPIAVAAISRFAGPLDFTATARFDDRTLAEARRLLTDGVNDTSIGFTHAYFHRIAELTAECQEAGLTDVVVHGVEGPGWPAAEAAQHGPHAESVFQGALHLARLYSTEPELVAVSSHLLALGSCPHQ

SEQ ID NO: 14064 - protein, 506 aa, Actinoplanes utahensis
MLRKRTLAVPFAAALTLALLPQPARAVDEVNTKKLRDAVTVAGILGHERVLQRIATQNGGTRASGTPGFAASAAYVGDVLRKAGYQVTEQKFTFPFFRDLSPAQLTPVTPAGPAYPTNTLTYSISGDVTGQVVPALNNVLPPTPAPSSTAGCAPGDFTRASATAPQIALIQRGGCNFAVKAANAAAAGYDAAIIFNEGQPGRTDLFQGTLGDPSAIPVVALSFADGSALAAAPGIVRVQTNTEINLAASTSNIIADYPGGDPNRVLVVGSHLDSVVPGPGINDDGSGTAQDLEIAVQLAKLKTKTHQKVRFAFWGAEEAGLLGSTYYVSHLSDTDLSHIFANLNFDMVASPNYVRFVYDGDGSATGTAGPYGSDQIENLFTTYFTAQGLPTAPTAFDGRSDYGPFIAAGIPAGGLFSGAEGVKTAEEATVYGGTAGKPYDACYHQACDNINNLNPKALNEFADAATHAVLTLAKTKTGFYPDGSLRAARRTATPANSLYRGDDLVR

SEQ ID NO: 14065 - protein, 482 aa, Actinoplanes utahensis
MQGEIFEYAGATVELLDASTILAAARVNPVDLVHHAAGWPAPVQRAEVTVSSRDTAAGPVHVFIARLHVGAEPMTTERMRGLVLGRDPIGVLLSKRIAEGDPVATRIVDGVGTAAAAAYRKLGFDRVDNPAANRQPGVLADAGVGLQAEVTHEAAGDVVRLRAEVPRDEVTATHLRAFVTLTLQAVAELADPDALRGRRFVFSREATPPPVPVTTQEVTLDMVGGLADVVAQLRQIAVSFRHPDAMARWGARRPQGLLMYGPPGTGKTMLSRALANEIGADFREIRTPEILDKWLGGSERNIKQIFRDARRYRVPTLMLFDEFDSIVSYAGAGGDAASQALNAVAGIFKQEMNDLFEANPNVIVVATTNFPARVDESLIRSGRFDIKISVPKPDEVSRAEIFRKMVDGLVAAHQRGAFRMFAEDLDVAALGVASTGMTGADIKEVLRRVQMNKAMQDARTGAADPITQQELLTEVRNLRGSV

SEQ ID NO: 14066 - protein, 534 aa, Actinoplanes utahensis
MTHEVFNQPPPLTGFDVAADAALTAALAREGAGWHTDDLHKLGSLAGSEQVQRWAEEANRHEPRLLTHDRYGHRIDEVDFHPSWHRLMEVAVGAGLAGAAWADPRPGAHVARAASFFVWSQPEAGHGCPISMTYAVVPALRNNPDLAALYEPSLTSRSYDPGLRTPAAKSGLLAGMGMTEKQGGSDVRANTTTATATGAGTWRLTGHKWFTSAPMCDLFLVLAQAPGGLSCFLVPRILPDGTRNTFRIQRLKDKLGNRSNASSEPEFDGTVAWLVGGEGQGVRTIIEMVSMTRLDCVIGSASGMRAALVQAIHHAEHRSAFGGPLVDKPAMRAVLADLAIESEAATLLAMRLAGAVDRREDAFRRLAIPVGKFWVCKRQPAVVGEALECLGGNGYVEDSGLPRLYRDAPLNSIWEGSGNVQALDVLRALQRSPDSLEAFFAEVDAARSADHRLDSAVRDLRRELTDRTDVEVRARRLVERMALTLQGSLLVRHAPSAVADAFCASRLAGDWGHTFGTLPTGADTAAIVERAAPH

SEQ ID NO: 14067 - protein, 330 aa, Actinoplanes utahensis
MTPFQRFVVWLRVPGRIPLLSLIAVILAVTYVPLWVVTIRSFDNLEQRENVDEAEELRVAPGAQLQRLSDFGMTNAIWTALYDDIRRGDQAHFAIDVPGSVVGPRYGMTAVIGTDLTGEVRVGGAIDGSAYTALPGALREPSTLRTLFDPGASADTGKCGFTSVTGAPTEFCGFPAYPDAGTPGGPSGGLLLFRELNAAALAEITEKTNDRLTVRAQPRPGREHGSLTASYGPIGVRTAVVDTAESTERITATLGALTASATEVSRAVATMTDTIGSVRAAIGQVRTVADGQQHTISGLMNQVQNAIGQIEDLGDRQQPAGGGGSDLELF

SEQ ID NO: 14068 - protein, 164 aa, Actinoplanes utahensis
MSTDEPRWLQAEEEATWLAMIKMLTRFPAALDADLQQTAGLSFFEYQVLAGVSMKPGRKARMSELAEFSACSLSRLSHTARRLESKGWLYREPDPTDGRYTLAVLTDAGWDKVVATAPGHVAEVRRLLIDALTPTQYRQLRQISERVNDAIGHNPCLGVHNKSC

SEQ ID NO: 14069 - protein, 210 aa, Actinoplanes utahensis
MSILRIDASILGPNSASSELADIAEAAWLETAPDTKVVRRHIGNEPLPSHAWQLATSAGYVPEADRSQAMNDAVALANELAAELRDADGAILALPFYNYGVSQHVKTWFDLAMAGGEQGEKFLDGKPVIVVTSRGGAYGPGTPREGWDHNTDYLRRVIGDIWGADLILIEREFTLVGLNPALDQFKDVAAEMKAAAHAAAAEAGRAHAAR

SEQ ID NO: 14070 - protein, 224 aa, Actinoplanes utahensis
MQSLGVRTTQAVGAALGLLVPFGGIAALVAGKWSGLREIDTQVADRLHEAALGHAALVDALAWWSLAFDPNTWRAAALVLAIWLVRRRERMLAWWVVATMAAGGALGGVLKLLFGRHRPDLLDPVARATGYSFPSGHALNNALGAAVFLLVLLPRTRGRAKRAALVTAAVAIPLITAYTRVALGVHWTSDVVAGLLLGAAVPAITVAVFQRRRVRVEGGRVQIR

SEQ ID NO: 14071 - protein, 238 aa, Actinoplanes utahensis
MSRFVKQAFTRIVLPVAAILLLMIGLGVLLTHVLKDENGFNRTLEHDRTPELTHISSFFSSVGNTMTIIAVTAVAALILRLTLHRWREPLFLCLAVTAQAVVFFFTTLAIDRPRPDVHRLDASPPTSSFPSGHTSAAFALYVGLAVVLASLARPGWLKALCWLLVLVPLAVATARMYRGMHHPSDVLSACLNSTLCLTVMGRAILNRDVPWRRAGIGSAAPAGTLQPAGNGAESTATS

SEQ ID NO: 14072 - protein, 563 aa, Actinoplanes utahensis
MGTRRHDGPAGAGRGGAGPDTAARALLARHEPPAGTGRRHRARRRGRDRPRPLACGRRRPAARRPRLPGHRRLPGTARDVPLLLSTQWVISARRHRSTGDDVTNRGTTRRGVFSALAGAAAATTLPTEPAEAAERPFQAAASSKPAQRPNILFIFADDLGWADLSSYGSPDIKTPNLDRLASSGVRFTQAYSGGAVCSPTRMSLYTGRYPGRLPGGLPEPIAAPSPTAGLPPEHPTLASLLKKAGYTTAMFGKWHNGFLPWFGPLRSGWDEFFGNYSGAVDYYSKITGQGVDLFEGETRVESDEYYTDTLAHRAEAFLRREHRAPWLLNLNFTSPHWPWEAPGDRAVSAEITARVRAGDTFALFHTDGGSLETYRKMVENLDVRVGQVLSALRQTGQEENTLVIFSSDNGGERYSYQWPLTGTKASLNEGGIRVPTIVRWPARIHGGQVSHEPVVTPDWTATLLEIAGAAPDPAYPLDGTSFAGYLLHGSPAPGHDLFWRTRQSRALRRGNWKYLRDTDTDQLFDLDHDPREQADLAQKHPDLVAELRARWEELAATQLPYPS

SEQ ID NO: 14073 - protein, 517 aa, Actinoplanes utahensis
MRRRRCGPGDAGRGRGRRPPLRAGVERHGPRVLCRSGATLRLAARQTNRRPVLGHQAGRRLPLVVRAVGGRRRLPPQGLLPARRRPGGQLRLEDRRRDHLPGDRSLTPAAGLSGTAARPAVFPQRAVAIRRPTVDRGRRHPSGHPPQPPAPSTVRPPTSPFRRCQSVPVLRTMSVMRTANWPALTFATGASLLITGLWQVGHPLLPLAELVAMGALVAYAVINTTTWTVPRRWTIAGLLLLAAAFSVADPLADATVGNDDSLMPWLPRELLIVAGGAALAIGLLLRSGLPPHAGPGLPRLVKLLPAAAFTVLTAAAAAKLSETDFLTTASPARTSLLTVTAMTLSAAGLAITAALAGPRRNAAAAIGLLPVLGTLIGALFTIGTTDALNAPVVTDPNFASWAPLQASISPFVLDQVRADRLHGDPGPRAWEPDVMMDQLERAGAEQARTQPPGHFWPVMNHRPVPAAVIVPDDEVVTDPGPWRAAGAALLLAGLASLVTAAFPARPETYLYSYRLSG

SEQ ID NO: 14074 - protein, 217 aa, Actinoplanes utahensis
MTKLSGREIAERAPGGWVYLLGVLRTRLRTGDFATGLALVDAIGAVAEEMDHHPDLDLRYGFVDVRTSSHDVGAVTGRDLRLAQAISELAGRAGVALDPAGLGGLEWALDTPAANGVAPFWAAVLGMRQQDHDGVNDEVRDPSGTLPAIWFQRSGSEEPRQRWHPDVWIDPSEVPTRIDAAVAAGGTLVSDANAPSFWVLADPEGNKVCLCTWQDRG

SEQ ID NO: 14075 - protein, 81 aa, Actinoplanes utahensis
MARYVHNDRLADALQGQAFTALRASPGARAYYDRQRTRGIGHRPALRQLANRLVGILHGCLKTSTPYNETTAWAHHLDQAA

SEQ ID NO: 14076 - protein, 540 aa, Actinoplanes utahensis
MGAEEITITGTTADRYSEILTPEAVAFVVALDREFGARRVQLLERRRRRRATRTTDLDFLPSTRAIRDDASWQVAAPAADLRDRRVEITGPPERKMTINALNSGAKVWMADFEDATSPTWENVILGQVNLKDALDGTLDWTAPDGRRYEVGADLPTIMVRPRGWHLPECHLRIGGRAVSASLFDFGLYLFHCGQRQIDRGSGPYFYLPKLESHLEARLWNDVFVFAQEQLGIPRGTIRATVLIETINAAFEMDEILYELREHSAGLNAGRWDYLFSMIKNRPDVVLPERSQVTMTAPFMRAYTELLVKTCHRRGAHAIGGMAAVVPSRDPVAAKRALNQVRQDKRREVGDGFDGSWVAHPALVETCREVFDQWLGDEPHQIVRKRDDVRVGAAELLDVKATAVAVGEVALRNNISVSLRYIASWLGGRGAVALGGLMEDAATAEICRAQLWQWISSGTPTDYGVPVTAAMVTRMLREELDVLSETGALDEEAARLFGQARTLLTVLLTERTCPEFLTLPAYLRHLSGGSAPVVTRATVAA

SEQ ID NO: 14077 - protein, 428 aa, Actinoplanes utahensis
MTELAETRGGTAADLTQAWASDPRWAGVKRTYTAEDVVKLRGTLQERHTLAERGAAKLWELLHTEDYINALGSLTGGQATQMVRAGLKAIYLSGWQVAADANLSGHTYPDQSLYPANSVPAVVRRINNALLRADQIDTSNGKYERDWFAPIVADAEAGFGGPLNAFELMKAMIAAGAAGVHWEDQLASEKKCGHLGGKVLIPTQQHIRTLNAARLAADVAGVPSLVIARTDALAADLLTSDVDERDKPFVTGERTAEGFYRVTPGDDAAIARGIAYADYADMLWVETGKPDLEFARKFAEAVHAVHPGKLLSYNCSPSFNWKKNLDDADIARFQKELGAMGYKFQFVTLAGFHALNHSMFELAKGYAESGMTAYVKLQEAEFAAEADGYTATKHQAEVGTGYFDAVSTALNPESSTTALSGSTEAEQF

SEQ ID NO: 14078 - protein, 483 aa, Actinoplanes utahensis
MTASPSDSVDLVTLGQRLRHLRRTRGMTLDQLSEAVGRAPSQLSLIENGKREPKLSVLQAIAAALGVPMQDLLRAEAPSRRAALEIELTHLQQNPVYSALGLPVVKGGRRLPPDALESLIGLHRELNRVLTEQSATPEVARRANAQLRADMRKRNNYFADIEAAANKILLSVRHATGPLSQRGILDVAAQVGFTLHYVNDLPTSTRSVTDLKNRRIYLPQVASGKGHDPRGVVLQTLGHFVLGHNDPADYGDFLRQRVEVNYFAAALLMPEKFAVDFLAAAKADRALAIDDFRDAFGVSYETAAHRFTNLATHHFGIPVHFARVHESGIVYKAYENDNVRFPSDVTGAIEGQPVCRKWASRTVFEADDPYSSFYQFTDTTAGTYWCTVHVESTRSGEFSVTVGTPYEHARWFRGGDVSGRTVSTCPDPDCCRRPPAQLVDRWAGNAWPSARVHSHLLAALPPGTFPGVDNRDVYDFLERRTGS

SEQ ID NO: 14079 - protein, 311 aa, Actinoplanes utahensis
MIDYDADRVRVARPAAAPARPALPGAGRPPPWHDARMTDDEQTRHQAGTTDDEQTRHQAGTTDDDVTLAEFTDLMRAQESGAGILATLADAVRHPRPDLPIVDLGCGTGLGTLRLAGSFPHHRMVAVEKSAAMRAVLFSRIAYDESLRQRITVLPGDLFTADLPGVWGAAVAVHLVCQLAPAQRADLWRLLAGHLAPGAPAVVDRHYGSTATMRVEERLACRTTVGDCTYERWFACAPADHESITYTDTYRVLRHGRILDERSVSRRSWIATEDDVIAEAGQAGLTVAWTTGEFLALTVEEGRLTHPGAGG

SEQ ID NO: 14080 - protein, 386 aa, Actinoplanes utahensis
MTIHPAAWAVLAFSFLVIPVLWVLIDRATLIRAGLARPVPAGAEPVQDFTVLVPIYGSVRYLENVDYLAQYGGRVVLCTTDGESAEFYAGLGGIAERHGFRIFRAAGVAGGAGAGGKRATSGTIRDRLVRDALEVAVHTPYVVCIDADTTTERPFGELVGQLVANGYDFASVPLVPTNDRSALGRLQAYEYRTAMKLRIIAPWQVSGACHVARTEAHREVMRRHSLFFQGNDVEAGLLAGALGLRVGHLPFHVATSVPETFKAWYRQRLAWSGGEFRLFAVNAHLLFRHPFFWLYGSVITLAGFPLRWLTLATGGWTLLAIFGLHSALIVYMHWPVRTRWLALMPLYTLFNSVVMTPLGAFWYFRMAIADRNAGLIRTNRPFPAKA

SEQ ID NO: 14081 - protein, 370 aa, Actinoplanes utahensis
MQNTPNPATLARLLGKHTEPLFSPATQVSVEGRSVLVTGAGGSIGSEIVRQVHRLNASQVFLLDHDEGALHALQLELLGHGLLDNDSVVLADIRDEQVLDRLFARIRPDLVFHAAAHKHLPLLERYPAEGIKTNILGTANVVRAAARAGVRVFVNISTDKAAAPTSVLGATKRIAERVTSAWAGDAMRVASVRFGNVLGSRGSFLPTLHWQLSNNLPVTITDPAVTRYFMTIPEAAALVVEAGQMASAGETYVLDMGEPMLIEDVVRRMAAALRTEPEIVYTGLRPGEKLHEELHDGIEMLGTTGHPRISTVTSYGAADRGLLYDVAMLAERLAEHDEDRLRAELRSLLRDAAGVDFPVGAGQPLSTGAR

SEQ ID NO: 14082 - protein, 249 aa, Actinoplanes utahensis
MRRRFTLPALTVAAVAGSLFVAVTPAFAHGYISSPPSRQANCASGAVTGCGDIVYEPQSVEAPKGSTQCNGGGSRFTVLNDNSKSWPAATVGQTVTFNWVLTARHSTATWEYFIGNTLLASFNDGGAQPGATKSHTVSMKGFTGRQTVLARWNIADTVNAFYSCVDLNITGGSTTPTPTPTPTPTPTPTVSPSPTTPPPTSGTTTWAAGTTYKAGDVVVYAGRSYQCRQAHTAINGWEPPNVPALWTAL

SEQ ID NO: 14083 - protein, 220 aa, Actinoplanes utahensis
MPAGTHRDQRLGAAERAGSVDRAVTMSSTMTPSGPVRRAASALLLTAALLGGCTAGTTSAAPAPSGAVNDVDVMFLQMGLAQIAEGDRVAALAEQHAGNPEIGRIAGELRGQWRTEGGTMQRWLLGWSQPTAADPSAGAHAGHGDLHALRESDFTDLAARHGADFDRTAVGMLLGTLHNGMETLRLESAAGAYPPARALATRMTGERQSQIQRLLRLAAG

SEQ ID NO: 14084 - protein, 46 aa, Actinoplanes utahensis
MPEPIVPTARPRTGRLEARDEGRGGVLEGILDTHIGRLRRHWITLS

SEQ ID NO: 14085 - protein, 309 aa, Actinoplanes utahensis
MIDSRRLQVLSEVARHGSFNRAAAELRLTPSAVSQQISALERSLGTPVVRRSTRGVALTEAGLVLIDAAQAITAELRTAQREIDRLATARTERLTVATFTSGGQRLLPPALTRFTAEHPGVELTVIESEPEDSLPLVRSGAAELALAYHFTGPPPVVGGDRSGLLWTPILDDPMWIVLPAGHPLAGAATLGLTDLAGERWVYGCPGQSDLLEHYAALEGLSVRVACRGTDYQFAQSLVRAGVGISMIPEVGLSQDRAGLVAVPMRPPGPCRYVGVATPRRRPSPLATALLATLREVVVALPPNPLTTPG

SEQ ID NO: 14086 - protein, 155 aa, Actinoplanes utahensis
MTKSGPVVGLLVTAALTLPTAAPAVAAPVPTGCGEACDQQDPQTYNTCGAGCPDNVPQHCADEAVTPHVSARGWVELRYSATCRTVWSRVGAAFPAHAEHWTETRYSNGRLRLATTPTTQTWSPMLSDADLAGRACAATLGPSGRHLIMDCTPWF

SEQ ID NO: 14087 - protein, 212 aa, Actinoplanes utahensis
MIRVLVADDQAMVRTGFGMIIGAQPDMEVVGEAADGVEAVEAARRLRPDVALFDIRMPKMDGLQALRLLAGPGVVDPVKVVMVTTFDLDEYVHQALRNGACGFLLKDAGPALLIEAVRAAHSGDALISPSITVRLLEHLSQPAPSTDDGGLSPRELEVVRLIARGRTNAEIATELFISVGTVKTHLGSVQSKIGLRNRVEVAAWAWEHRIVT

SEQ ID NO: 14088 - protein, 378 aa, Actinoplanes utahensis
MNRILLGFLQVAGLGLMALLGIVDVTGSMTESPLFPIQVALAIGAAAVWLPHYKPGSILLPTAAIAAAGASLLVTAGLAVTDPYGGLWGLAESTALLITLTLVARNARPDWAVLALVATGAAVSVMPLRSGHSTIYGTFCLIQALGAAGAIGFGVTLRITAGNRQRALDTVRAEQRAEFARDLHDFIAHHVTGIVVQAQGARFIAEQDPKRVLLALEQIEQAGTETMTSMRRMVGVLRDPQSRPDAPLAPVAGVPELAALADQFTAAGGPPARLHLDGDPHGLPVEVSTSAYRVVMEALTNTRQHAPQATAVDIWVRRLRDQLLIRVANDGPAPRPTLDRPGYGLVGLTERVRAAGGRISSGPGVDGGWVVDAVFPIP

SEQ ID NO: 14089 - protein, 255 aa, Actinoplanes utahensis
MQTQSSPLAGRDALAAVAAVDLVKVYGTGDTAVRALDGVTVGFERSRFTAIMGPSGSGKSTLMHCLAGLDTATSGQVLLGGSDLTKQSDRVLTKVRRERIGFVFQSFNLLPQLTAAGNITLPLDLAGRKPDAELYDRLVTTLGLAGRLGHLPSELSGGQQQRVALARALVSRPEVLFADEPTGNLDSRSGAEVLGLLRDSVRQLGQTIVMVTHDPGAAAYADRVVLLADGQLAGEIRNPDIASVTDALQKLAAGR

SEQ ID NO: 14090 - protein, 835 aa, Actinoplanes utahensis
MNTILRTQMAGAARRPARLLLTGLAVLVASFVVYATVLARDITERSVLDGLSGTPETVDLIVRNGALNDKQLAQITALPGVAGTAARTEVGGQLGGQYLSITADPGSGPLALVKVAQGRYPSAPGEIAITPRTVQLLGLSIGSTVGVDPGSGRKVPLKVVGVVDPPHDFGGDAYAPSNTVIGLTPEPYLQQIDIDVAAGADAGPIQEKIQAMFAGAKQEDRPEVATGADVRLEEARQAASQIDSLFAVVGMFVGIAVAAAGLIAASTFRIVFAQRMRQLALLRAIGAGRGATFRALAAEGALTGLVTGTTGVLAGQAAGFGIPALLRGFGWKVQNPGIPVLWAIGTILLAVVISVVAVLAPAVSAARVAPLEALRAAAGTGARTGIGVLRWIGGLLPLAGALALAGYVMVNLPKPDQKDYDAQTMLLAVVASGALAFVALIALGPVLVRPVLAVAGWPLRRLGPVGRLAVGGVGGSARRAAAVSVVVALGVTLVAGVLVGGASVRALGERELAASAPADFELTGGDGVTVPAEMVAKAKASGELTRVVAYRRLAAASIGDIDHVAVTDLDVPSVPRLADLDVRSGSLADLAPGKAVISSFTAESAGAGVGGQVTVANGAKKVTFTVAAVLGDDAPLHASLLVTPADLTALGAGATFNGILADAAHDGESGRTEALRAIRAVAGGQGDYSVTVLADQRDELNSELATLLGIALGLIGLTVLIAVVGVGATTALSVVERVRESGLLRAIGMSRGALRTMLTAESALYGVIGAVLGLLLGVPYAWLAIQAIGVNAPLAVPGWQLAGAFLALVALTGAAGVLPARRAAKVSPVTALGTE

SEQ ID NO: 14091 - protein, 665 aa, Actinoplanes utahensis
MTPTVLIVDDSLTVRMDLHDAFTDDGFTTILCATGAEAREAFTRAEFDAAVLDVLLPDADGLELLTELRASAGHANVVTMLLSVESDVSDRLAGLRIGADEYIGKPYDAGYVVARTRQLLGGQPSGRAAGGAPAILVIDDSMTFRERLRELLEPEGYTVLTASGGEEGLRMAADRRPDAVIVDGVMPGVDGATVIRRIRLDPALRDTPCLLMTAADDYATEMQMLDAGADAFVRKQQDLAVVLAKLAAVLRQSAEQLPIEGIGGLHGPGKVLTVTPDRDEQECWAEALRTDGYDIVACRDVTEALALLGEQPADCMVLGFDHDLAAAQAACRRVREVPQVGDIPVVVVGREDHMLECLAAGADDYVRSSDVPEGLRVHVRAQIRRKQSHDEARRIREELMRRELDAAEERAARQLAETRAAMVEELEWRNRELEAFSGSVSHDLRGPLQVISSFAEHMLDEADDEQLGEQTRHRLGRIHAAALRMADLVESLLILARASRGELRRARFDMTATARQVCAEVAARDPDHKVDFQVQEGMTADADEGLVRVILENLVNNAVKFTRKVERPVITVGFADDTYFVRDNGAGFPAGKAGELFRPFARLHDARDFPGTGIGLTTVHRAIERHGGEIRAEGEEGQGATFRFSLPPADGPPGPERRGQARRSG

SEQ ID NO: 14092 - protein, 357 aa, Actinoplanes utahensis
MIRVLVVEDSATMRYHLREALTEDPELEVVGEAVTGEQAVTLTGRLRPDVITMDMMLPGISGLQATEHIMAEHPTPILVVSSADRQELFSTYNALAAGAVDVMEKPRGDDSDADWAPRLRRTLRMVSRIRVITHPRARLDGRARAASPSLPPTPAATMPHPANAMTLIAVGASTGGPAALTELLRSLPPNFRPPVLCVQHIAASEQFAVAFSDWLAGQTGRNVRYATDGTPVRTLTGQVLLAPPDRHLYVRDHVLRLSDGPPRHSCRPSVDVLFESVATEYGNLAAGCLLTGMGRDGAAGLLQMRHRGAITFAQDEHSCTVYGMPREAALLGAAMHVLPPARIAARLAELQPVVIRR

SEQ ID NO: 14093 - protein, 702 aa, Actinoplanes utahensis
MAESRDPLRYFRIEAQELVEQISAGVLDLDQQRGAEPVARLLRAAHTLKGAARVVRQKEIADRAHEFEEILVAHREDAAGLAAGDMRELLRLNDEISAQVTALTRPPAPPPVVETTPALETTPAVVATPAVEVAPEPRAEPVAETVAPRAATADLDDLLDAITETTARMAPLRAGSRVVEKLRTSAETLADQLRGGRTAAAVTHASARRLAGELGSAGRRLSDAVDQIERELDDVRAKAESLRLVPAGSIFTALRRAVRDAADTEGKQVRFVTHGADVRMGSHLLGPASSAFLHVVRNAVVHGVEPATERAAAGKPAEGTVTFEVERQGRYATFRCTDDGRGFDVAALRHQAQARGLLPGAGPADAEVLDLVLHGGISTSATVTEVAGRAIGMDVLRDVAAQLRGEVRIRSTPGAGASVELVVPLALLSMTGLLIEAGGVTASLPLDAVRACVRLSPAEAETAAGSGRLVHQHVAMPYQPLIEALGVGRPAPDAAGPGAAVVLHGDQGAAAVGVDRLLGTHSLVARFLPELAPTTPVISSVSIDSEGNPRLVLDPDGLIREMVHDPATAGRPAVAPVTPPLPILVVDDSLTTRMLERSILESAGYEVDLAASGEEGLERARSRRYGLFLTDIDMPGIDGFTFVERTRADPELAAVPAILVSSRASAADRDRGIRAGASAYVVKGEFDQEELLGHIRRLVVRA

SEQ ID NO: 14094 - protein, 488 aa, Actinoplanes utahensis
MMDGQTFGRKLGFGVGLTGLLTLLSVVVSTLCLLFVVHAKDRVIAAATHELTGAENLNRLMEKRLGDYRGFMLYGSDEFATATGQDRADFLAQLADLQNDSSTAVKALLKQTADAEAKHAEWVDVVMQKRTQTKDPLAAAALNNTQAMPLRRQVQATLADLIATVRSDVEADRRHSSRQANLAIAVIVGLGALTTASAVMVAWRLSRDLRREVGAAVGHIQSSSAQLEAAAAQQVNGGRDQASAINEITTTINELLITSRQIADSAQRVSQIAEETEAAARTGDATIDQTRASITAIRTQVDQIVQHMLALGEKSQQIGGVVDLVSELAEQTNILAINATIEASGAGEWGRRFAVVAEEIRKLADRTAASAKEIRALIDDVRGAVNTTVMATEIGAKAVDAGARQFDEATNSFREIAQLVSTTNDATREIELSTKQQTTAVEQVNLAVSDTARVSRETESSAVQTKQTAAHLSTLSGDLLELVGTRSH

SEQ ID NO: 14095 - protein, 177 aa, Actinoplanes utahensis
MTDRVLSRVERLRAEFDHSFAVPLRTLDDESVELLAVGVGGRAYALRLSQTSGLYPNRPVTPLPTTVPALRGLAGFAGVVVPVYDLAALLGHPIAEQPRWLVLAAGSPPLALAFHQLDHHVRVPSADVVDGSGAASSRGCLRGMVRLPDGDRPIVDVPATRVLAHRMAGHEHPEVSS

SEQ ID NO: 14096 - protein, 458 aa, Actinoplanes utahensis
MSGEPPLVRFREILERRLGWAAADTEAVPVLPVLAERAAARQLTESAYLDRLAGRAWPEETVILAERLSITETYFFRHGDQFRALASRVLPQRIEARAGQRVLRMLSVGCSSGEEAYSLAIVAHRVRPAPDWIVAVLGVDANPEVLRRARRAVYSEWSLRETPPDVRSRWFRSVPDGYEVAREITGSVQFVEHNVAGPEDPRIWQPGRYDAVFCRNLLMYLTPATVRGVLDRITGSLADGGALFLGHTDSLGSAPPGFTVEHHGDTVFYRRSIAAPTPQPAPRAAPPRVAPPPRVRSPRTPEIRSRALDLLRDERFAEALDLLAPVSSQHPLLYGVLLAQLGRLPEAAAVATRLIDAGAPQPDAHQLLGLCREIDEPDQAAAQYRLAAYLDPGFAMPRLRLGLLARREGDETAAAAELTAALDLLPRESEERITLFGGGFGRLTLSVLCRAERDGARR

SEQ ID NO: 14097 - protein, 177 aa, Actinoplanes utahensis
MGQLRQAPAGEAGTIALVFQAGPLFCALPLAEVIETMRPLPTRPLAGTPSYVRGLTILRGEPAPVIDMTRLLTGVSSGIDRYVAVHAGRGPVACATGPVLGVRTVHAVPPEGPSTLFTGASRSLVAAVGTVGTEPLLVLRSIRTVPDEVWDAAGRDRDTAEPGTAQAVAAHDTGATG

SEQ ID NO: 14098 - protein, 87 aa, Actinoplanes utahensis
MPRAARFGPAPASGRPPRPPEPAAHSLSAHQVGISDSGWRFAFRDRRPRDGRSRFSVEAPALSVLCRAAGGRRPATGVPSRPASVPS

SEQ ID NO: 14099 - protein, 373 aa, Actinoplanes utahensis
MRVPRGYGSPVRNRYLDLLRAAAIVRVIVYHLFGWSWLSIVMPAMGVMFALAGSLTAASLERRPARDVVTSRVRRLVPPLWLLGLLAVPVMIALGWSREHGGEHPFKVWKLAFWILPLGDPPGSELAVDAWEPLWYIRAYVWFILLSPVLWFLWKKLGPACWLLVIAPILAIVALDKTGFELPETADVVMWDFVTYAACWITGFAHRDGRLRRLAPATVVFLFVTLSCAGLYYQSGHQGDDPWDLNDVSESQSLYSLAFVLLALRWQPSMTWLSRTNLLDRAVTLLNARAVTVYLWHNLAIAAVWPVLSFLTADDLGHLEKPVTLGMTMTLTAVAVLLFGWAEDLAARRRPRLWPDTAIPAAADPAPTAPAPS

SEQ ID NO: 14100 - protein, 260 aa, Actinoplanes utahensis
MRKPSVVLSVATAALVAGGVATTRALAQEPPDVAGFTIFGGPVTSDASPAPDDAGPDPAAGLGTAPATIPARVITRKPAAEPTAEPTAEPAVEPGPIKAVAPKKNYGFAAAADPIAASHTEVTVESISSSPYAPVQQQILALVNLQRGRAGCRPVTIDRRLIDAANGHAAEMARRDYFDHASPNGKGAGDRVSANGYPWRLYGENIARGQRSPWEAMDAWMNSPEHRANILDCKLDQMGVGLAIDGGHTPYWVQDFASPQ

SEQ ID NO: 14101 - protein, 250 aa, Actinoplanes utahensis
MAVKRVSARLTTAALAAMVGGGLGAFAVTPASAGAAVRTTPVATSVVTRAAASSCATGRYQKQVETYLKQLGGYGTVTVDGRQSAADCAAIVRFQKRFGIQPAQGLAGPTTVDVAKRLASTKIAACKPNRKGITFCVDLTNQTTWVMKNGKLFVKPTITRTGMKGYHTPAGTFKINKRTPKEWSDPYHVWLPYWQRFIGGRGFHQTTTYLHDKWRGSHGCVNLLPQDAKQYYGIGTIGMTVKVFGRRPGT

SEQ ID NO: 14102 - protein, 450 aa, Actinoplanes utahensis
MCSVSRTPSRSALITGGTAVLLLLTAASCKDDNAGVHLGTATIGTVDEIVEAPGSVTARGAATLTAPAAGTVTDLRVQPGDRVKKGDVLAVIDSPELRQRRDAARRALAQTPSGGGGGVSAGNFTQVRRSTDRQAGQAFQDALTAADQITDPTLRDALRKQVSAAQQQYRAASAAAASAVRAVQRGVASLGQAVSSLSAAQRLQAQQAYELADAAVRALTLKAPVAGVVQFGGSASPAAPADLSALLQSGGATTGATTTAGGAEGVDTAVTEGSPVTAGAPLLTVVDVGRLGLTAQVDETDVLLVKPGVTADVELDAATGAAYTATVGSVDLLPTTSARGGVSYRVRLDLGDGTYTDGSGAAPTPRPGMSAVIRLRVRQVQQAVTVPASAVVSADGHDTVWAVRDGHYRAVPVRLGVQGEDTVQVQSGLPAGERIVISGADRVHDGAEAP

SEQ ID NO: 14103 - protein, 228 aa, Actinoplanes utahensis
MTTPAIVATDVTRTYELDGVSVPALRGVSLTVEPGDYVAIVGTSGSGKSTLMHLLGGLDRPTSGTLLIGGRNVGELTPNELAELRNTTIGFVFQSFHLLARTTAQDNVGLPLVYRGAGRRERRARAATMLQRVGLAHRITHRPNQLSGGEQQRVAIARALVTGPSLLLADEPTGNLDSATGQSILALLESLNAEGVAIVLVTHDRDVAARAGRQILMRDGLIVTDTAE

SEQ ID NO: 14104 - protein, 394 aa, Actinoplanes utahensis
MRVAEAWRVALDALRANRLRSLLTMLGVIIGVAAVVALVAIGTGTKQQIEHQVEGLGSNLLIVVPGKLAVGSAPTSSPMTLADADAVSRVVGDRSRVAVTIASGETVRAGQRSGFASMQGVLETTPSVFVRHLARGAYLTRTDVSTGRRVAVLGAGVARTLFGDRDPIGRQMTVGGVRFRVIGVFEELGQSLGVDRDNEVHVPVTAAQRLLGTDRIDGLAIRAPDRDTIDRLGTDVVAALTERHPDTDFSAVTQEQILGVLGDILGVLTGVLAAIAGISLLVGGVGVSNIMLVSVRERTREIGLRKAVGARPRDIGVQFLLEAVLLTTTGGVAGMLLGAAAALLVDGLSPVPAALTWWSMALAFGVSAGVGIIFGVVPAQRAGRLDPVVALRTE

SEQ ID NO: 14105 - protein, 282 aa, Actinoplanes utahensis
MHQRVPAPLLVLASIASVQFGSSVARKLFGDLGANGITFLRVGLAALIIAALTRPRVRDWPRRAWLAAALLGVVMAGMNLVFYQAIRTVPLGTAVTVEFLGPLLLALVQTRRLTDLLWALLAAAGVVLLGLHSGGAAPLAGLGLALLAGLFWAGYIVLSARVGALVPGTGGLAVSLSVGALLAAPFGLPGAGAVLYHPHLLIGATGVALLSSVIPYGLEINALRRIPTRIFGILMSLEPGAAAVAGLIVLGQRLGPIEVLALLLVTLASLGVTLAAPQPAPV

SEQ ID NO: 14106 - protein, 348 aa, Actinoplanes utahensis
MPYQLRDQHGASRAVAYLMMVAGPYNLITGVLMKIGAPIAELISLGVTAVALMLVGVLCWRRPQVLPKLFWPAVPLLSTAVVTGLNYGTRDASTGAQLFFLWPLLFGACFLGRRITTLTVVMISAGHALIAFSYLPMSGALNDWIAMTVAMAMTAWVVTSLNDRNDRLRRVLQQQATTDSLTGVANRRALDEALHEAVRDADAGAEPAALIVIDVDHFKKINDTRGHAAGDQALRAVADALRAAGDGLVARVGGDEFAVLLRTGPTEAFRYAETARAALTAVPAAPTLSIGVAVVPHHSAASADELQRVADAALYQAKEAGRGRTVIASAPARQNVDRIPEARATSAF

SEQ ID NO: 14107 - protein, 255 aa, Actinoplanes utahensis
MLSVRAEVYRLLGELGMAAAASRLALAHAESAQDEQSMVIAQAELAHVLRLRGDWMEADRLFQRAVDSQVSPAVRSVVHENAGRSAFDQGRHMEALDHFARAIRLGADEDTDLVERVGVCLEAVYIHVLRDGWGPYPRRPEEILAPLTGRNAEEPPESKGHTAEEPAASKSHTAEEPAASKSHTAEEPAADKGHTTEEPAASRGRDGTGNPATGERSDSATYHNPATADSHGGHGIRADAFSEPTAEQKTVRKRT

SEQ ID NO: 14108 - protein, 709 aa, Actinoplanes utahensis
MPASMNGPGAPGDPAGTPHFERPVAPPLRLLGAQPGQPTTSHPRMAGPQPDQPVAPPPGLVPSQYTGSTGGPASPPPMAAPGVVPPYAGSEGTAAAPQGWHAGPGGPVTPHGQHAGPMGSETPHGQHAGPGGPVTPHGQHAGPMGSETPHGQHAGPMGSETPHGRHGVAPGSPAAPHGRPVALPNGFVPKSDQGAVPPVSGGAPGGPGVPGALPNSGTAGPAPFESGRLTFPPGTLPQQGVHPQSPSAPGWVPDQAVVQGPAQPQNPAAAHPVSSGAHREGVYQEAAHAAGGQPAFPAAQWNADPHGTDQVGRGFERAAHSPEGPGHTREAWPVSGAGHWEANQHGGPLPHGAVRQGVPHQRPMPEAPWPVSSPGQAMQAQPGLGQAVPAQAVPGQAVPGQAIPAQAITGQAIPGQERVTGELPLVAARDGGGPTGELPLVAPADSGGPTDELPLVASGDDSWGPRAGQRPVSPAPGKAWLPAPRPDSSAAPGATDAALGATGPVPGTIGAAGAAPGATGPVPEAAGAVSGPASGGASGGGEPAPYMDADGTWHNLKPIGRLELSGPDQEPRRFSDPAFGSGWFVTKTAAAKEDAAGAADGAGGRGSDGTAVRRSGGEAGVATRAVTDAAAGSQDHGSQDHGSQDHGSQDHGIQDRPTQDHATQDPGAEKSGSHDSGTQDGGAQAPAIVEPTQAGGSAARGNDAGRRAS

SEQ ID NO: 14109 - protein, 53 aa, Actinoplanes utahensis
MADRYTGLLVDWHTRLLVEGYTGLVADRYTRLLVERHTGLLTDGQRRSGGLAG

SEQ ID NO: 14110 - protein, 879 aa, Actinoplanes utahensis
MSFEDDEYWDEEYNEYSFMPKYAVAQERHFEKRTAPDPVIPTRRSNTDSDDSGARRPRAPFDDQRPSWLDDPDFVPIDTSVDNLSGDYFDDIDFNRPELGIDFDKPDFPIVDPAALQNPERRQRQAGRPGDRYGAPSGRREDGAPVRRDAGLSPRRDGAASGRRDESSAGRRDDALPGRRENSLPGRRDDALPGRRDDALPGRREDALSGRDAASPGRWDDARGSRPVERRDDDRRGRREDEPRRGRREDERWDGPEPRRRDAEIDADGRGRVGERRGSGPVPRPGDRGRGTVSQPWEDEDFGPIRPVGGRRPHRDDEDPRRGPARRDDRTGAVTGRAQVPGGEERLDDRRRAPLDADISGIDRRKRPVDADVPGADGEIRPLDASGADRRNRPLDAFGGDHENRPLDVSGADRRGVPLDADASGIERRSDGPRVSGRAGSPARDDEPIDLHAQDWNAPRATTGWNNTNAEWPTADTERSAAAPEWNGSPGHWDGAADQWNNDSDQWDGEPQQWDGEPQQWDGEPRQWNGEHEQWEGAADPGRAGQGVPAWTADERSGQRDDRAIGRDDRTGEDDDRPMGVSVPTVLDGEYYETPVEPPAQDPAATGDGKPRVVRRAEPPAPPKVVSRATPPPAPRVLKSEPPVAPRVVAAPQPTPPARIIGPNGPQVPVAPAASGSPTPSASPAMPPSSPESPVPVSVDSGTPAAPRPGPATPVSPTAADRAGHHPAPLSAMDHPAGSAPSNTTPSAMPADPRFANPHPPFPGPQQTPGAIPHQPGAPGQTGGPGQFVDSQRLNGPGHLTDPRQTAEPGQITGSRQGAGPASPADLRQVGGPTQLPDPRAVSGAPQPGGPAQDPDSRQFGGPAQVSDPRQVSGPALAS

SEQ ID NO: 14111 - protein, 123 aa, Actinoplanes utahensis
MFAVPSPGRPREAASRPRAKCREHSVNRSLPLGTDVTERHDQRVMPTPGTLRLVATLGAVPGLRPTVDSAIPPMVTWEDGPSGRAAAQALVASGYTVSEQFWGGGVVDVPTSNHAYSSASCGP

SEQ ID NO: 14112 - protein, 383 aa, Actinoplanes utahensis
MRIALVTESFMPDVNGVAHSVVRTAEHLIRTGHEPIVIAPVPAPGPVPATLPYPVVRIPSVPMPGYPQIRLGLPMPALRAAIRDHRAEVVHLASPFVLGAWARTAASSLGLPTVAVYQTDVAAYARARNLGVCEDLSWRWIRRLHNAATRTLAPSTESMTALRTHGVERVHLWRRGVDDVRFHPGRRSAGVRRALCRDGEVLVGFVGRLAVEKEVDLLAGVSRLPHVRLVVIGDGPAEAHLRRALPEATFLGARHGGQLARIYASLDVFAHTGPFETFGQTVQEAMASGIPVVAPAKGGPRDLVHHDHTGLLVPAHEETGFTDAVARLAADPSLRRAMGAAGRAAIAGRSWSAVGDQLLHHYAEVLGRPLARQEVARPRAAAA

SEQ ID NO: 14113 - protein, 543 aa, Actinoplanes utahensis
MNNDRTGVRHRLLDACRSSRLGLLVARRRDHLPVLTTRALRWAGFGGALLLALAGLFGGALPDEGGHNLPVTTLWLAGTALLGYAWWSGRDRELSPRWVLGTAALWAVPFLLVPPVGSRDLYSYSCQGELFAHGLSPYTSTAQTLPCSWVGAVPPIWRDTITPYGPLFVLLAGAIILLGQAVALPSGLVDALPPHLGSLILPLVLFRLVALGGVVAMAAGLPVLARRCGIAPARALWLSLAGPLIGLHLLGGPHNDAAMLGLLVGGLAVVTRCPRHWAARVGGGVLLGAAVAVKATAGVAIPFAVLIVAATYRSRLQGLVIGTLAVAGSSVAALAGITVAGGLDLGWIAGLSDSGALVQFSSMPTAVGMTITYAGRLFDPDFDAVPAVRAAAYAVLAVALVVIWVRALRDRADPVRAALFGSAAAIVATVALAPVFLPWYMLWPLTLLAATTLRTKAVMVITIVASFSVLPDGSGLVRSLKFPGAPMVTLYLIYLGVRQVRRWRGGRELQALVAADGISEAEPSTRATATSMTTRAGLGRGVR

SEQ ID NO: 14114 - protein, 473 aa, Actinoplanes utahensis
MDATPTIGSPVVPGSAGDEGFTSLRRPARPRAERYEMGRALRERSPRSDVAQWRPPADRPDPVGQVRASHEGRLPWLVPVRIGRMIASPYAFLRGTAGLMADDFAGLPHTGITPVICGDAHLGNFGFYASPERDLVFDLNDFDEAHPGPWEWDLRRLVVSVHVAGRVNGFRESACAEAVQHCVEEYRGQIADLAARPLLARSFDRLNVDAMRSVATRGSFRDEIERAARRARRRTSDRALPRFTERRDGSRRLVEEPPVITRPSDADRDLLDEALDGYLNTLKPHWARILGGYRVIDVAHKVVGVGSVGLRAYVALCEGSDPEDVVFLQLKQARRSVIAKHQHGALAWHRHQGQRVVEYQQALQTVSDPLLGWTTVGEHQYYVRQFRDMKGAIVVEDINAGALADYAGICGYLLAKSHARTSGASMIAGYCGGSDKLDESLAKFARSYADQVEKDHQALVAAVRRGELAAEVA

SEQ ID NO: 14115 - protein, 337 aa, Actinoplanes utahensis
METKGSRSPAMTDVARLAGVSHQTVSRVLNDHPNVKEQTRLRVRAAIAELGYRPNRAARALVTGRSQLIGVVARNSMLYGPASMLTEFEQAAADAGFAVSVGSVRELDRDSIAAVVDRHLDQRVAGLVVIAQVASATEALAEIPADVPVVCIDGDPAAGRSLVTVDQVAGARAAVRHLLEAGHETVWHVSGPTDWFDSAGRIQGWRQTLQEAGREVPPLLSADWSAAEGYRAGQMLARMPEVTAIFTANDHLALGVLRALHERGRRVPHDVSLIGFDDVPEAAYFIPPLTTVRQSFGDVARAALTLLLGQLRDAPRPADTVIVPARLVVRESVAPPA

SEQ ID NO: 14116 - protein, 505 aa, Actinoplanes utahensis
MTAPRHQRKRMKPQIWFLTGSQHLYGPETLQQVADQSAEIQRTLAAGLSAELVTRPVLTDSGAIKQVMLDANNDATVIGVIAWMHTFSPAKMWISGLDALRKPLLHLHTQHNISLPWESIDMDFMNLNQAAHGDREFGFIQARLGVPRKTVAGHVSDPSVVSRIDGWARAAAGLQRLRTLRLARFGDNMRDVAVTEGDKVEAELRFGVSVNTYGVNDLVTVVDAVDDKAVDDLVAEYADRYELAPELAVGGARHDSLRYGARLEAGLRQFLTEGGFGAFTTNFEDLGGLRQLPGLAVQRLMADGYGFGGEGDWKTSALLAAVKAMGTGTGRGTSFMEDYTYHFGPGEPKILGAHMLEVCPTIASARPRVEIHPLGIGGREDPVRMVFDATPGPGVVVGLADLGDRFRLVANAVEVVEPDEPLPNLPVARAVWKPAPSLSTSAECWLTAGGPHHTVLTQAVGAEVLRDFATMAQTELLLIDDRTSTDDFADRVRWNQAYHRLARPL

SEQ ID NO: 14117 - protein, 375 aa, Actinoplanes utahensis
MKYTRLLAALGAATLVTTMAACGSSEKTADKAAGSGNTAGALIGITMPTKSSERWIHDGDNLKQQLEGLGYKVDLQYAENDIPTQTQQLDSQITKGAKLLIIASIDGTAISNQLDNAKNAGIKVIAYDRLIRGNANVDYYTTFDNFKVGVQQATSLLTGLGVLKADGSKGDAKGPFNVELFAGSPDDNNATFFFNGAKSILDPFIKDGTIVVKSGQTDFKTVATLRWDPETAQKRMENILTSTYKSGAKVDGVLSPYDGISIGILSALKSGGYGTAAQKFPIVTGQDAEVASVKSIIKGEQYSTIYKDTRQLAKVTGEMADAILKGQTPQTNNTTDYDNGKKVVPAQLLQSVIVDKDNYQKVLVDGGYYTADQLK

SEQ ID NO: 14118 - protein, 511 aa, Actinoplanes utahensis
MTDTILRMTGITKTFPGVKALQDVDIEVRRGEIHAICGENGAGKSTLMKVLSGVYPHGTYEGDIEFEGEPCHFGGIRDSEHRGIVIIHQELALASNLSIAENIFLGNERSKRGWINWNETNAAADDLLRRVGLKEKAVTPVVELGVGKQQLVEIAKALSKDVKLLILDEPTAALNDDDSAHLLNLLRGLRDEGITCVIISHKLNEVMGISDRVTILRDGRTIWTDEIENLTEDKIISGMVGRDLEHRYPEHEPTVGEEVLRIEDWTVYSPTQPDRALVRKANLTLRRGEIVGLAGLMGAGRTELAMSVFGRSYGVNISGRLIKDGKEIKARTVREAIDHGIAYATEDRKRYGLNLIEDIKRNVSAAGLSKLAKGGWVDGNEEFKVADEYRASMNIKSPTVEAVVGKLSGGNQQKVVLSKWIFTDPDVLILDEPTRGIDVGAKYEIYTIINRLADEGKAILVISSELPELLGICDRIYTLSAGRITGEVPRAEATQESLMTLMTKEEQEVAP

SEQ ID NO: 14119 - protein, 415 aa, Actinoplanes utahensis
MTVAPTNADLSISEGPAGAGNAAQRKVNFDLKSSGIYIALALLVLGFTIWTGGDLLAPQNLSNIIVQYSYILVLAIGMVLIIIAGHIDLSVGSVVAATGAFSAVMMVNWGLPWPVAVIATLVIGALIGAWQGYWVAYFGIPAFIVTLAGMLLFRAVTYMILGNKGIGPFPDEIRTLANGFIPGFLGNVGLGSLGGADLFSLVVGILVVVAMVFVQWRARMGRVRYRQAVDPMWLFVAKVAVPAALVIFLVVQLARFRNLPWVLVLLAILVCAYTLVTNRAVFGRQIYAVGGNLQAATLSGVKVKSVVFWLFVNMGVLSAVAGIIFAGRLNLAGPTAGNSFELDAIAAAFIGGAAVQGGVGKVVGAITGGLIMGVINNGMGLLGRAPEEVMLFKGFVLLLAVAFDVWSKRRTATAK

SEQ ID NO: 14120 - protein, 48 aa, Actinoplanes utahensis
MGRHGDVAAHCRHRATAQPKLLGRTPGNTPSSDPKPQRLCSTSPITDR

SEQ ID NO: 14121 - protein, 404 aa, Actinoplanes utahensis
MIMNGTVSRRSILGATLAGVAGAALSTRVAFAAGAYSGDTLVVISLRGGFDGLSAIVPIGDSAYYTARPGIGVPKSQVIAGDGTFGLHPALAPLLPLWQGGRMAAVHAVGQPNPTRSHFAAMEAMENAAPGTSLRSGWLDRMLGLTGATAPLAGVSLGHAMPARILLGAADDVAMTGLDGFSLAGEGKRPMAAALRAMYADAPAALAGPARSADRALAAVHTVRDAAYAAAATYPDSELGAALRDVARLIKAKAGLVTAAVDCGDWDMHNGLGTAVKGQRMYDNLADLAAALAAFTTDLGPALGSVTVLTISEFGRRVQENASHGADHGHGNAMLLLGGGIRGGKVYADWPGLTPGALVAGDLAATTDYRSVIGEVLQRRCGFGSLDGVFPGVRPSSFGCAVAR

SEQ ID NO: 14122 - protein, 465 aa, Actinoplanes utahensis
MTTADDLVAHLLRRTTFGATPDSLAEARRLGAAGWLDRQLDPQRIDDSRCDAVLARLPLAGATPAQVRAALPKDSYEGFRQLGRAAIARAAWSERQLFETVAAFWANHLHVAAPSAGVWDTRADYDAQVIRKHAFGRFADMLRASARHPAMLTYLDQRSSTRSHPNENYARELMELHTVGMAYDEGDVQDAARLLTGMTVGRTGDYVYDTTRHAVGGVDILGFRHANAGVNGEPAALAFFDHLAMHPATARNLARKLCVRFVADEPPAALVTRLAKVYLDNGTAIVPVLRALFTAPEFAAAAGQKVRTPFEDLIATVRVLGLGPDADGVKGLDALYDIAVTAGQAPFRWAPPNGYPDVAAAWASPSAFLLRCNWHLNLAAGWYPKQLSRPADLLRALVPVLPATYGALIDALATRLIGTVLPPAHTAAVLSAAGKLPNTVLDRSLAGHTPYLIALVLDAPSFPLR

SEQ ID NO: 14123 - protein, 349 aa, Actinoplanes utahensis
MDQAETVRTPSSWVVVGLDNGGTCNNATVLDATGQFLVNNLVENPSRVLDGPESAVESLAEAFTNILELTSTPLSLVRAVGLDTPGPASAHGVISSKGATNFNQVSWHGFDIRGALETRLGLPVIYNNDANAAALYAHHRHFGTAALETSSVAAIVGTGLGGGVVENGKVIRGAAGMAGELGHVQIPLHGVLDDGQPVPRCNCGFEGDVESIASLTGIRNNLLPYWLTRFPGHPLAAEPIGSAAKMLRGYGEKDDPLAIAVFSQQARAIGKLFTIAANFTDPSAYFLGGGVVEAAPHFRQWFLNTVRESTQLRDEQARAATFALVADLDMAGARGAAVAALDAVSTGTR

SEQ ID NO: 14124 - protein, 111 aa, Actinoplanes utahensis
MQVSVAHHPPNTAVLVLRGSLDIDTAPALKANLGRLVERPAPRVVVDVSGLDFCDSMGVGVLVTAHGRAMERGGWVRLAAPSGFLRRLFDTLGLSDYLPMFPDVAAALKDE

SEQ ID NO: 14125 - protein, 496 aa, Actinoplanes utahensis
MDQPQLIQERSAPPATLVIFGASGDLTRRKLLPAVESLARHNRLPDQFALVGVARTPMSDEQFAESALGDRTLADKRQLAGGVRYVSGGYDDPETYKRLAETLDELDAQRGTSGNRLFYLSTPANAFEPVICGLAGAGLNQANEGSFARLVIEKPYGRDLATARELDGVVHAAFDESSVFRIDHYLGKDTVQNVLALRFANSIFQPIWDRSWVDHVQITVAETLGVGTRGGFYESAGAMRDIVQNHVLQVLALALMEPPASFGGEGLRSEKVKLLQAIRLPTDRDIADAAVRGQYTRGGTREELMAGYREEIGVDPLSRTETYAALRLNVDNWRWAGVPFYVRTGKRLPARVTEVALQFQRPPHLPIPTSQLTELDADALVLRIQPNEGISLRFGAKVPGHSFRVRTASMDFSYDQTFVEESPEAYERLLLDALVGDASLFIRSDEVEQSWRVVDPIIEHWANDRSPIPTYEAASWGPADADRLIGRNGRKWRNSI

SEQ ID NO: 14126 - protein, 312 aa, Actinoplanes utahensis
MKYRLVTRSDFDGLVCAVLLRHLDMIDDIMFVHPKDVQDGVVDITDRDILTNLPYDARAYQVYDHHHSETIRNEGDRSNHIIDADAPSAARVIYDHFGGRARFPKVSDDLMLAVDQADSADYGLTDILSPTGWTLLNFLMDSRTGLGRFRNFRISNYQLMMQLIDACIEHQDVHEILALPDVAERASLFHECSARFVDQLHRVTHMDGDVVVVDLRDEEVIEAGNRFMVYALFPDARVSVHIIWGRQKLNTVFACGKSILDRTSPVDIGEVMLRYGGGGHIAAGTCQVPHDESDRVEREIIDALRTERVVPV

SEQ ID NO: 14127 - protein, 403 aa, Actinoplanes utahensis
MGTALTLVTAAGVLSVTAGPAYAGVTVSPPSVPQGSGQNLTYHVENDGTRPLTRVTLQIPADTPIAEVYPLSVDDWAPQIEWQNLNTPLKTIHNGTPVTQVPKSITWIAVGGTSIAPGGAADLSVALGPLPTLSTITFQLTGAYADGKPAPAMPATLTLTPDPSGATAHDHGSTGATDSGTAAGAAGSTGGAAGSTGGAAGSTGGGSAGDSASADEDELFRQAVAEVEQNDRGASVLGIVGWIVAALALLGAGWLILRNRHRANETPDDEPDETPEPAAATPSGDTTASAASGGTSAGPADGIPVAAADSGPGATADSARIAAADSVPGATADDARIADADSVPGATTDSARIAVADSGPAGGAGIAAESAAAAPASADADGGPETTDDDREPIPAGRWSLKG

SEQ ID NO: 14128 - protein, 75 aa, Actinoplanes utahensis
MPDDGRMRDVSINGEMIRLGQFLKLADLIDTGGEAKVLIASGDVTVNDEVDTRRGRQLHPGDVVEVLGNRARVVP

SEQ ID NO: 14129 - protein, 287 aa, Actinoplanes utahensis
MTRTRGLLAATAIPLILMAGCARPGEAGSITESAPAPTADATVLVRLGYQGGFVPEIYRFVRLPEVTIYADGRVVSNGPVPAVAPGPALPNVQISKITPERARQWAADAVAAGVKDGADFGTPGVADIPDTVVTAVTDGRAQTVHVTALRETRPDDAQVTAAQKAARAKLAAYVDSLRALATETGSPAPDAYRPESVAVLAQPYVPVDDGLEQKPVAWPGPALPGATLSGTVHCVAVSGAELTKVWAAAATANQRTPWTSGGKQWQVMFRPLLPDETGGCAALGKAS

SEQ ID NO: 14130 - protein, 213 aa, Actinoplanes utahensis
MLAAQILVALVLLAVLAFGGMAVFAGRRSPVTPAPEPEPEVVELETGAGEVWAAAQRAAQAADQARERATEANGERDQAEERYQQAKWDSWTGPKDEGRTLVERAALEAYRRGDLSVDQLNRIWAQTRPGEDEVERMDQEIAEAKLRYAAALTEAVEERRAAHVAEVAAEVLAEEARLAEETALAARLAAQEAAGLSGLLQGPGEHPGPPAGQ

SEQ ID NO: 14131 - protein, 122 aa, Actinoplanes utahensis
MNKPDVGHIPDEAPADLVIEDIVEGTGPEAKPGEYVSVHYVGVAQSTGKEFDASYNRGQALGFRVGGQQVIAGWDQGVAGMKVGGRRKLTIPPHLGYGAAGAGGVIKPHETLIFVVDLVEVH

SEQ ID NO: 14132 - protein, 243 aa, Actinoplanes utahensis
MRLFVVLAAAATLTAAVPGTAAFAHGAPTTPISRSAACAGNGTKTSAAACKAAKAASGGFLGAFDNLRIADVNGNDRKAVPDGKLCSGGLDAYRGLDLPRDDFPSTAVRSGQKLAIAYRGTIPHQGQFRIFLSKPGYSPLKRLTWDDLGSKPLAAFTDPAFSDGAYHMSVTLPQRTGKQMLYVVWQTSSTPDTYYSCSDLDFPAAPAVQRSTAAAPASPASPSSSASPATATPLAVASSALAS

SEQ ID NO: 14133 - protein, 92 aa, Actinoplanes utahensis
MSRSRYRAQAFPRLNRRRMLALTAAGVGVSAVSVAGLSLAGENSTTSASDSSPLVISVRDAKKGTFDVFVGDAKKTVTDKKLVAQLLKAAGR

SEQ ID NO: 14134 - protein, 460 aa, Actinoplanes utahensis
MSSHREAPEISKDPVADSSDLYAFVSPDDPDTVTIIANYVPLQIPASGPNFFEFGDDVLYEIHIDANGDARPDVTYQFRFHTELRNDRTFLYNTGQIESLDSKNWNRRQFFSVTKVDRHGKQTVLANKLPCPPCNVGKISIPHYAKLAEHAVHKLKSGEKVFAGQRADAFFVDLGAIFDLGTLRPFQNKHLVGKTLFNYAGKAVNATDKTNVHSIAVQIPLSAVRRDGKKRVKASDAGAVIGVWTTASRREVQVRDGSNVLVGPQVQVSRLGNPLFNEVIVPMAQKDKWNSLPPSEDKRFAEFVAKPELGSLLPVLYPGLFDNLAALNKAGKDRADLLAILLTGIPSGIIDGFQNNTGSLQADMLRLNTAIAPAAKPNAFGVVGGDLAGFPNGRRIADDVVSISLRAIAGATVPLVDKAFKPDAAASLVEQGLSIKDVSSGLLKKFPYLGTPFDGFSVPA

SEQ ID NO: 14135 - protein, 120 aa, Actinoplanes utahensis
MSHDHHHHHTLAPSGQGTVMLNIGGRIGALIIHTSARFHGHEIEISSSADRDTRQHAAVRARYVGGGVTYCVVIDALAEGTYLIWAADPEPLATVEVRGGAVAEYAWPENAVPGRTLLTV

SEQ ID NO: 14136 - protein, 327 aa, Actinoplanes utahensis
MSGGEVPVHVALHTSDVDQARAFCRRLYYDPLRIEPVGDPGRFDFSADVVELGPITVGEVGYGTDIRVAIGALETSYHVLVPLTGVLRSRHRGTLVVADPTRAVVYRPTGDIELDWPGTCRLLSVKVERGALERELDAALDQRVVSPLPLGASFDLVDGPGRTWVALVRLLLSELRGPDALASQPRMAARWRDMVVSGLALTVEHPYGDEPAGLQGPHRPRTVKRVLDALHAEPARPFTSHELATIAGVGVRVLQDAFRQHVGMAPMTYLRRLRLDGVHTELSRSDPATTTVSEVAYHWGFTHLSRFAGAYRARFGVPPSTTLRGRP

SEQ ID NO: 14137 - protein, 137 aa, Actinoplanes utahensis
MPPMIRIVMGALVRDDQMLLVHRSPSRPVHPDVWSLGGGHMEPGETELAALARELDEELGVQMVPGSAIHLCRLQVGRGGEAVHFSAWIVEEWEGKPVNAAPEEHDEIRWFRPAELPPLTPEPVRTALIEAMRNTRA

SEQ ID NO: 14138 - protein, 192 aa, Actinoplanes utahensis
MPPRRRSPRSRPAGHCPHPAPNVGFSWADHGGSGEWISTPTVMGRSANQPEFPRGARRTVVAHVDSGYGSEVRLSVPWVRTVVAVQLYVLAAYLAAAIIPYLWAPRQYPPTWLWVVPGLLLGSPGYYITVWGASLAVPLALIGAAASGWAGLRHTVPPRLFRWSLTTAALTAVYALFTLTSLGHDIAMFVAD

SEQ ID NO: 14139 - protein, 455 aa, Actinoplanes utahensis
MIPSCARKAAPLFREGLRTRACRPSPVVLAVAALQVAAATLALPIATPAAAQAAAPYRKVGYFSRAAVKPKAEGGADFQIRDLDEKGSAAKLTSLHYAFGSISAAGECQITSDEARLDYQQEYPATDSLDGVADQPGQALRGVFNQIRRLKAKYSLRTSISLGGGSGSANFAEAARTAVSREKFVRSCIDLYIKGDLPQLGGQPQGGIGAGAGVFDGIDIDWEYPGATGNSLEKHNYTLLLQEFRRQLDAYRQGAEGRPYYLLTAALPGGAYTLGRGYELPAIFTYLDWAVLMAYDMHGAWESPSTTNHQSALHLNAADPDPTDRSVDIYLKNLTDHGVAPGRLVLGVPFYSRGWTGVDATDNGLFRPGTGVSDGRDYRTVKEYVHNGFVRHWDDTAKAAWLFNGNTFWTFDDPAVMTEKAGYAKAAKLGGIGVWALNQDDDQGALLAAIDSGLR

SEQ ID NO: 14140 - protein, 330 aa, Actinoplanes utahensis
MAADRRLALHATLPDRYAHLEVMASTIDHDGRLVVLLADPAQGFVAVPHLTELRPPPLYDATALICAGLEVREIPLKGLDLWFSGIDSLGDGVVLSAARCAAPGVCEERYGEPVPEEDLTLTANVRVFDGHGRAQAAFYAGDGIEQLVTDARGQIWISYFDESNYWFPHSDGTRSYGFMIGLARWDGGGGEPWMVSSGTPTLPWCDCYALNVGRERIRACPYPDFAVVELDANSVRAVVDNPITRCTGLAVVGAEFAFFDQHRAGDGFRWGIRRGRQDGERIIETGREQLELPDGRQPSGWARGRVGRDGMLWLRMDGDPGRWYRYDIDA

SEQ ID NO: 14141 - protein, 774 aa, Actinoplanes utahensis
MPPSSSGTGRCRRRTRLGNTGEDGASGARIAGVSDDGSPPTGAAGRGRAAWLLVALSGPGALLIGFGGPRIAPTAYLIGVLICVVAGGFGIGKNLGAGRRRPWVLLLAAQAGAVAGEAARTLAHATVFPNVMLLVSYLMLGAGLIDLLRRSRAGADEPARVDAILLGAGSALVVWSLWMEPWFAGHDPHWENLVAAALPLVAAGLLMIVLPMLLLGRTGAPAMWFFSVSATALLAADIVLAVRGWFDAGPRTIPLAEVGAAALIAYAANSACMLHPTVVVLTQPVPNRSQQLRMSRTAAITAALCAPTVLTVVAPPHGLRFALVRAVLSLTLIFIAVSRIVRANNSRARAEQRARWQADHDALTGLPNRDLLTSTIADWPGVSVLFLDLDRFRLINDHWGHEVGDELLRAVAHRISAETRADDLVCRVGADEFIVAVRAEDPAALAGRLLTVLAEPVPLSVGAVDVTASIGIAHSPGRPDPVELIRDADTAMYRAKDAGRRRAVVFDPELRDRVRTRITLERAFRGASGNGELDVHYQPIIDLPTGQVDGFEALMRWTHPTLGTVSPAEFIPVAEDTGLIVPAGAWLLEKAAGQLRTWRAGNPALHVSVNLAVRQLWEPDLAERVREVLGRTGLPAAGLWLEVTESGLMTDLDTCLDALHQLRALGVTLCIDDFGTGYSSLSYLQRLPVSIVKIDRAFISGVGLGGADESIVRAVLAMSRALGHRVVAEGVETAAQHDWLRANGCDLGQGWWYGKPRPATQAVPGSSHPSPATG

SEQ ID NO: 14142 - protein, 410 aa, Actinoplanes utahensis
MAVKVLAIVLAGGEGKRLMPLTADRAKPGVPFGGIYRMIDFVLSNLANAGYLKIVVLTQYKSHSLDRHISKTWRMSTLLGNYVTPVPAQQRLGPRWFAGSADAIYQSLNLINDESPDYVIVFGADHIYRMDPKQMVNDHIASGAAVTVAGIRQPLSLADQFGVIDVGPDGKKIKAFREKPRDAVGLADSPDEVYASMGNYVFTTRALCEAVTADAQNPDSKHDMGGNIIPMLVERGEANVYDFRDNDVPGATDRDRGYWRDVGTLDSFYEAHMDLIATLPIFNLYNHEWPIFTNYGSWPPAKFVHGYDDRQGRAIDSMISPGVVVSGALVERSVISPNVRVNSWAHVDGAVLMEGVSVGRRAVIRNAIIDKNVTIPEGAQIGVDLDRDRKLYTVSDNGVVVIGKGQRIEL

SEQ ID NO: 14143 - protein, 864 aa, Actinoplanes utahensis
MQQFRGVPGEIRIPGVAVHDARAGGAGRHGEIHPHGAQRGVRPGQLGGLRVRGDTLLGAGCAEAVHPHVGEPPQVPGQVFQVHAGAAVHLRRIFTGQEVHTQSHAPHNSPPQPAATRSGTRPATAVGCNGRVREWSGPGAWRYVLVAGAVAVTVAQLTGSGVLFLLIQVATIGATLRLRLGAGWWLQTVARVAAVVATAFWMWGPVPPANTPTGFSLVPLYLLSAAGAALLTRRGGRHYSRAEISVEAGAVVLGVAMLAWSFVVLPYLGAPGYQQVDSALAALYALVDMALLATTLRGLTSRHGAPARLLGGSGALLLGAHMLYAATSSAGVGPFLPGGGSFLLIQYAGVLVTAAARHPRAGALGTGDPRGTEVSRGRLARIIAIAVLAPMLPLLTARHDVATWVPALLTSALCGLLVLRICMLARDAGHRAAELCRAVDEQAALQRKLAYRAGHDSLTGLANRELLLEQLATPAVRDRPHCLLLCSLDGFKAVNDAYGHPVGDEVLRQLAGRLLLFAPEAVLVARLGGDEFALLLTDPAGAADLAARVLDTISRVPVSVDERRIHLCGSAGVADGVPGNPPSAVLGDADLALRAAKLAGGARLARFDERLRAEQSERACLAAGLRQALADETLFLHYQPVVDPVSGRMSGVEALMRWRRDGELVPPGVFIPVAEQTGLIGPIGLRALRLACARAAGWHRRDGIYVTVNVSTHQLRDPDFADTVLAILAETGLPPAGLVLEITESVLIDAADTPVLGRLREHGIRIAIDDFGTGYSSLAYLRQLPVDILKIDRSFISDVSFTKAILELARSQGLITVAEGVETPEQAAVLRDLRCDLVQGYHFGRPAEPAAIESWIRESSATVA

SEQ ID NO: 14144 - protein, 533 aa, Actinoplanes utahensis
MTRVQRLRLGLLLSVVLIAALAIGAGLVRAAFYRASAAAPVTGPAAAVAGTVAQCAGQPARAARELRGMWLTTVYNADFPSRPGLGEDQVKAEYERWLDLAVAQNHNAIFVHVRPSGDAFWPSAYAPWSNWLTGRFDGRSPGWDPMAFMVSEAHARGLAFHAWFNPYRGTQPAPGGIGTDAAKLAPNHPLRLHPEWRIAYPTGRTGRFYFDPGIPEARRFVEDSMLEAVQKYDVDGVHFDDFFYPYPEGSGQDFPDAASYQRYGAGKSKADWRRENVNTLVREMHERLLQVKPWVSFGISPFGIWRNRATDPLGSNSAGLESYDTIYADTRRWVQSGWLDYVAPQLYWTIGFSKADYLTLLKWWTDLTRGTRVQLYIGMADYRVGEPGDWSDPAMLDREMALNRKYAAQGEIHFSAGQVRGDRLGAVSRYRRAYYATPALQPRLDRLAAPAPATPRLTTARPGPAGRLILTATGLGATNWSLYRTTGGPATLVATGRSGAEIADPHPSGKATYCLGAVDRSGTESPLSPALSS

SEQ ID NO: 14145 - protein, 149 aa, Actinoplanes utahensis
MNRTTVRAGVLATALISGVLGVAGPALAAPVTDAAPVAAAGTAVAPIAATFNVTAGFTSWGQNVYVVGSIPALGSWDVSKAVPLTTTSSAFPTWTGSVALPANTYTEFQYVVKNADGSVARWEKGFQQNRTTITPPTGTYVTHDTFGAY

SEQ ID NO: 14146 - protein, 125 aa, Actinoplanes utahensis
MSDATATALAQDRVIDITTIGRRSGEPRRIEIWFHRLDGRYYITGTPVKPRDWYANLVANPAFTFHLKETATADLPAVARPITDPAEREKVFTGLLAPLTEFTSKPGLEQEVWVAKSPLVEVTFA

SEQ ID NO: 14147 - protein, 129 aa, Actinoplanes utahensis
MSTIITFFTAANDDAADDHGPGRDAVAFGNFDIFASLEEWESLLLRRDLDDVDGPEQINDDEPLIFSFLPAVTKALAAADRRTLDTVSREWVAARAGDGEELDPELAREILDAVAGLARSRRRLYCRVA

SEQ ID NO: 14148 - protein, 543 aa, Actinoplanes utahensis
MSATLIARDLAAGHGDHHLFTGLDLVVAPGDVIGLVGVNGAGKTTLLRTLAGLLPAESGTVSLSPPTANVGYLPQERERRAGETVRDFLARRTGVAAAQTAMDTAAEELAAGAPGADDRYAAALERWLDLGGADLEERALALTSSDVRIDLELPTTALSGGQAARAGMASLLLSRYDVFLLDEPTNDLDLDGLAHLENFVQGLRGGLVVVSHDREFLTRTVTKVLELDLHQHQIRLYGGGYASYLQERERARSHAREQYEEYSDKKEELLERARTQRAWMDKGVRNARRKAPDNDKIGKSLRGETSEKQAAKARQTEKMIERLEVVEEPRKEWELRMEIAVAPRAGAVVATLREARVDRGSFTLGPVTVQIDWGDRVAITGANGSGKSTLLAALLGRLPLTAGSAALGPGVVVGEVGQARGLFLGTETLARAFGDAVPEFNDADVRTLLAKFGLRAGHVNRPAGSLSPGERTRAALALLQARGVNLLVLDEPTNHLDLPAIEQLESALATYPGTLLLVTHDRRMLSAVATNRHLEVADGKVTG

SEQ ID NO: 14149 - protein, 595 aa, Actinoplanes utahensis
MPLSAGSRPASVRSSVVLPAPLTPTRPITSPGATTRSSPVNRWWSPCPAARSRAISVALISQSSKHRPRLNLHDGESSADHPCVRRLERVMVRDPITLAAVAWTALGLVLLFALAGHYNSQVRVFWLFQPPLDLLVAYSSWRVSRIATGAVGRFWRMLMVTSALFLLGDSVQSVLSLTRQHQWSTGGGVIQSVCFGTGELLIIVAMLIHPYPGRSRREALAFWLDSATVMVGGAVVTWSFASSSGPQDENASPIGALVGAAVALTAGFAAVKIFLSGNAPMHKAAAVPMIGSAVVIGVSVFAAPPSTQDGLPAYVYALRFVPSLLIAVGPRIQEIIAGFDQTAFGARRRRPYSLLPYGSIAVVFTTLLVVLPQGSTRRLWGVVGGLGVIVALVVARQLAAFHDNTRLIDQLDSTLTELREHEQRLRHQALYDELTGLANRAHFREETTTALEDAHPGSVALLLVDLDGFKAVNDTHGHGAGDLLLAGVAEKLRQSVRAGDLVARLGGDEFAVLLRDCTVRDAEQTAQRILRSMTEPIDVGDLAVCANASIGIACAEERDDVRTLLHDADMAMYASKHQGKGTWNRYQDGMALTGH

SEQ ID NO: 14150 - protein, 270 aa, Actinoplanes utahensis
MMESYAAFTTDPAGGNPAGVVRDAAALSDARMLAIAADLGYSETAFVTSRDGDRYRVRYFSPLTEIPFCGHATVATAVALGPGEHVFLTNAGEVPVTVDTHGVATLTSVPPRVEPLGADAVSALLAALRWAATDLDPGLPPRVAYAGAWHPILAVRGRERLADLDYDVPALKALMTEAGWTTVQLVFRADPQTFDVRDPFPVGGVYEDPATGAAAAALGGYLRELGLVADDATLTVRQGDDLGRPSRITVRLVPGEPGVRVSGHAVPIGQ

SEQ ID NO: 14151 - protein, 474 aa, Actinoplanes utahensis
MTEGPTAIISETPADLPRTLGELRATGHEFRTVKEELRDNLLDRLRSGEPRFPGIVGYDDTVLPEVERALLAGHDMVLLGERGQGKTRLIRALAGLLDEWTPYITGSELHEHPYHPLTPASRRLVAEAGDLLPISWLHRSERYGEKLATPDTSVGDLIGDVDPIKVAEGRSLGDPDTIHFGLVPRTNRGIFAVNELPDLAERIQVSLLNVLEERDIQVRGYQLRLPLDLLLVASANPEDYTNRGRIITPLKDRFGAEIRTHYPVDLELETALIRQEAALVAAVPEHLVDVLARYTRGVRESSSVDARSGVSARFSIAAAETVAASALRRAGLRGEREAVARICDTVSVTSTLRGKVEFESGEEGRETEVLAHLLRVATAETFRARLAGLDLSGFTDLVAEGAIIQTGDLVSAEELLTQIGTVPGLAKVLDRLGLGDAPSPGQAASGIEFVLEGLHLTRRLAKEMTDDGRTLYGS

SEQ ID NO: 14152 - protein, 650 aa, Actinoplanes utahensis
MARNVFRYGAWRDGPDPLAPPYDVRAAVDEMGERVMRGDSLRDALRDLIRRGPRDGRGLDDLRDRARRLRRDALRRGNLDGAVTRARQMLDQALAEERDTLRARDDMESRFNEAVLDNLPRSTSQAIAELSEYDWQSPEARDIYRQILSGLRREVVEQRFAGMRDALRNGDFSEVSEMLGDLNGLLGKHARGEDTTDAFQQFMEKHGRFFPDNPQNVDELIDSLARQAAAAERLMRSLSPQQREELQSLMDQALGDGPLRGQMSELTDNLRALRPGLNWGRGERMRGSEDLGYGDAAAALGDIADLDELIDQLGQEHPGATLDDVDVESVERQLGRSAADDLRRLRELERELRRQGWVERDGDGLTLSPKALRRLGQTALAKIFHDIGGKRGDHDMRDAGAAGDLIGSSRRWEFGDDQPLDVVRTIGNAVRRRAASRDVATLPVRLAPEDFEVAETERRSSAAVALCVDLSYSMYADGRWGPMKQTALALSHLVATRYPQDALQIIGFGRYAMALSQGELAGTEPTLEKGTNLQHALKLAARHLRRHPGAEPVVLVVTDGEPTAHLEDDGEALFWWPPTPETVRATVREVDLLTRYGATLNVFMLGDDPGLQRFMDAVARRNGGRVFSPDAEELGRYVIDDYVNARRGRH

SEQ ID NO: 14153 - protein, 106 aa, Actinoplanes utahensis
MATYQAPDGWEILGDPSRRAIVSCLADAPRAVGELADRLPISRPAVSQHLKVLKAAGLVDDEAAGTRRVYRLNATGVAALRDQLDAFWRQALQGYQQAVSSEEETP

SEQ ID NO: 14154 - protein, 157 aa, Actinoplanes utahensis
MTRSTTPIVLRQIVVPASVQRAFAVFTQRFGDIKPRDHNLMTAPITDTVLEPRVGGRIYDRAADGGECTWGHVLAFEPPHRLLFSWDIGPNWQVEPDPANRSEVEVRFVAEADDRTRVELEHRNLDRHGPGWEGIRDAVDGDNGWPLYLHRFVTALG

SEQ ID NO: 14155 - protein, 321 aa, Actinoplanes utahensis
MQASTHQISDVGEAREVLRKYFYAVDMDVLRKRRDWTARFAVGGCTAVTLGDLDFGVDVRVSAGELGAYHVNLPLTGGLSWHQGRDAPRRAWAGRSAAVFQPVGDTIVDRWDGDCRLLAVKISRTELETHLEQLLDRPVRGPVQLAPVLDTAQGPGAGWARLARLIVEDVGCPDGLTGHPVIGARLREALVTGLLLSTEHRYRDPLERQTPALAAPGAIRRVVEAMRAQPARPFTVADLARIAGVGSRALQQSFARYVGMPPMTYLRQLRLGLVHDSLAGAEPGTTTVAQEAYRFGFTHLGRFAAAYRERYGTAPSETLRD

SEQ ID NO: 14156 - protein, 227 aa, Actinoplanes utahensis
MKKRTRRRIPFDEARPEGAKGVEMTTVTDVRAEIAAQRRELAALLAELTAEQWDRETLCDGWRVREVVAHVTQPFRASLPRFLVDFARAGGNFDRMADRVARRDAARLSSAALLAAVRDNVEHPWSPPGGGLVGALSHDVIHTLDIDPWREVPVARMTLVLGGMSPRSVGYFGADLDGVRLVATDRDWAHGAGEAVHGRAQDLLMVICGRRLPPGLLTGHPAARYTG

SEQ ID NO: 14157 - protein, 327 aa, Actinoplanes utahensis
MAIFGDVEEVLAGLRVELTGYCYRMLGSGHEAEDAVQETFERALRAAGRYDEARGSVRTWVYRIATNVCVDLLRGAARRAVPLDLAAPGSAGEPFGALLAPGAEVRPIPDARVLDLAQDPATLVVQRESIRLAFVAALQHLPPRQRSVLILRDVLCWSANDVAALLESSAASVTSALQRARATLRTVAPHPGDPLNPADADQRTLLARYCAAFESHDIAALVALLHEDATTSMPPFAWSLHGRDRIGLAMSAPEAACTGHRLLPTAASGQPAFWQMRPTEAGHVPFALVILDIADHRVVNTTTWLDTTGRHLPTPPPSLWSLFNRHP

SEQ ID NO: 14158 - protein, 38 aa, Actinoplanes utahensis
MLSDRDTHIPEVREARRPAESSAAQRVVTDFGMPDRLA

SEQ ID NO: 14159 - protein, 204 aa, Actinoplanes utahensis
MSYSSIETSNRIFTIPNVISFIRLLGVPLFLYLLLGPERDVAAVIVLAVGGTTDWVDGYVARRMNSVSRLGELLDPFADRLYILATLIGFTLREVVPWWLTGGLLLREVVVGVALLILRRHGYGPPPVHYVGKTGTFVLLAAFPVVLLAKAVPSIDWWAGPVGWGLAWWALGLYWAAGVLYLVQAARLLRADRDGRAAARTVTP

SEQ ID NO: 14160 - protein, 398 aa, Actinoplanes utahensis
MGAGPVLGGRRALPGAGRAAVACRPGRSGRGPDGHAVTDPAIPGGALPEPAKPDAAPQHSGARRPTPTSQESGTRKPTPASQDPPARRPNAATPDPDGTAAGKRTYGPDFLTALFQNPLDPGYADAAARRAEGHVRTGARKRLTAGFSLLTVGVIGFLLVVGYQQTVADEPGRTQARDALIKQVDSRREQTETLQTRADVLAEQVARLRAQELGGAAVAGISNLEAATGLAAVRGSGARVRLADGPTSVDAVTGERSTLGRVKDTDLQLAANALWAAGAEAIAINGQRLTATSTIRQAGEAILVDTRPVTTPYEVIALGPDSLVDNFRNGYAGKFFPALAQQYGMSFETERVRDVTLDAAPELKLRAASPSTPPPAPSGSPSVAGSGVPAVSASEGGR

SEQ ID NO: 14161 - protein, 110 aa, Actinoplanes utahensis
MIAVLALLVGVLLGIVFHPSVPAELVPYLPIAVIAALDAVFGGLRAKLDGIFDDKQFVVSFISNVLVSALIVYVGDQLGVGSQLSVGVVVVLGVRIFGNVAAIRRHLFRA

SEQ ID NO: 14162 - protein, 365 aa, Actinoplanes utahensis
MTDREDDGRELTPPGFDLPTAGRRPPTARPSAAFDELAGYAGDPAGDEQTVRYPVAPGGDPAGDAATRAGDPETSPTSPVPSMSDTPEPASTESDLDRLRESPGEDPRESPGEDRGDVRSGPGESADGGERPPGRGGLKRPAPAGTLIWVLLALLGFTLVVQLRSNDADSGLSTARQEDLVQILSDLEARDSRLNSDIEALERSRQQLTSGVAGREAALDEANKRSQELGLLAGTIPGRGPGLEIVLDRVKASDVLNTVQELRGSGGEVMQISGSGGTPVRIVASTYFIDATGGGIIADGDRLTGPFRLLVIGLPETMRTALQIPGGVVASVKSDGGSVTMDSRSMVEVTAVRKAAALQYARPVS

SEQ ID NO: 14163 - protein, 126 aa, Actinoplanes utahensis
MIPENLRYTAEHEWVSGDGTGPVRVGITHFAQDALGDIVFVQLPEEGTELQAGDSMGEVESTKSVSEIYAPIAGTVVARNDTLGDEPELINAEPYAAGWLVEIAPADPAAVDALLDAAAYQALTES

SEQ ID NO: 14164 - protein, 150 aa, Actinoplanes utahensis
MTRPDDEFPPLDVTSTLNLGALDEVLEGPETDVVPSRMSGSLPPGMALLVVRRGPNAGARFLLDHDVTTSGRHPDSDIFLDDVTVSRRHAEFHRDGGVFTVRDVGSLNGTYVNRERVEAATLSNGDEVQIGKFRLVFIAGPRPEGEGGRA

SEQ ID NO: 14165 - protein, 246 aa, Actinoplanes utahensis
MTSSGAAARDPGAERPQGGREGALMSIGEVLAHLRTEFPDTTISKLRFLEAEGLVDPQRTASGYRKYSWNDVARLRFVLTAQRDQYLPLRVIREQLDRMEQEPVVPQRPTLVAVGAQRATDPADARIPKDDLVERTGVDEAMLAELEQIGLVVARPPGWYDADAVIIVEAVVGLTHFGLEPRHLRAFKNAADREVGLFTQLLAPLARQQDPAARARATDTARELQALSQRLHAALVRTGLRGELGR

SEQ ID NO: 14166 - protein, 167 aa, Actinoplanes utahensis
MRDGDNNEHGGGAVRELSVVGVRVELPSNQPIVLLREVDGDRYLPIWIGAVEATAIAYEQQGVKPARPLTHDLLRDILAALQQPLKAVEITELKDNVFYADLLIGENLRVSARPSDSIALALRVGAPIRCADQVLTEAGIVIPDEQEDEVEKFREFLDQVRPEDFAG

SEQ ID NO: 14167 - protein, 182 aa, Actinoplanes utahensis
MHEQPLEGPLVGEDGEVGYRGVTACQAVGISYRQLDYWARTTLVVPSVRDASGSGTSRLYSFRDLVVLKVVKRLLDAGVSLQNIRRAIDTLRSHGVDDLAGITLISDGTTVYECRSPEEVVDLLQGGQGVFGIAIGGAFKEIQGSLSHLPAEPAVPQPVGQVPEEPAAGDELAARRARRRAG

SEQ ID NO: 14168 - protein, 762 aa, Actinoplanes utahensis
MTSSPPAGPAAVLADPQRHEFIQVRGARENNLRDVSLDLPKHQLTVFTGVSGSGKSSLVFGTIAAESQRLINETYPAFLQSFMGSPARPDVDALHNLSAAIVVDQERMGANARSTLGTVTDAYTMLRILFSRLGEPGAGSALAYSFNAEGMCPRCEGLGRVSSIDVDGLVDRDRSINQGAITVPNFSVGGWYVRGFAESGLVDPDKPLREFTEQEWADFLHKPPVKMRIGGVNTTYEGLVLKVQRMYLAKERESAQPHIRAFIDRVATFTTCPECAGARLKPAALASRIAGRNIAECSAMQVSDLAGFLTEVTDPAVAPVVRGLRHTLESLVEIGLGYLSLDRESGTLSGGEAQRVKMVRHLGSSLTDVTYVFDEPTVGLHPHDIQRMNGLLLRLRDKGNTVLVVEHKPETIRIADHVVDLGPGAGPDGGRVQYQGPVAGLPGSGTLTGRFLGHRAALKKACREKTGTIAIRGASRNNLRDVDVDLPSGVLTVVTGVAGSGKSSLIYGSLPRRDGVVVVDQTAIRGSRRSNPATYTGLLDAVRSAFAKANRVKPALFSANSEGACPNCKGIGLVYLDLAMMAGVAGVCEECEGRRFTARVLEYRLRGRDISEVLAMPVSEALEFFTEKPARAILDRLSAVGLGYVTLGQPLNTLSGGERQRLKLAVHMGGGPATYLLDEPTSGLHLADVDQLLALLDRLVDAGNTVVVIEHHLAVMAHADWIVDLGPGAGQDGGRVVFTGTPHELVADASTLTARHLREYVG

SEQ ID NO: 14169 - protein, 640 aa, Actinoplanes utahensis
MCGLSAFFSSRPEAGPVDQATVAAFTAALESMRHRGPDDSQLAYGDGYILGFNRLAIIDRDHSVQPLYYADRWLVVFNGEIYNYRELRAELISAHGATFATEGDSEVLAAAFHYWGEAALPRLRGMFAFVAYDTRTGTVHAARDAFGVKPLYLLETADGLSLASERKALDPFAAPAGAALNNDALGHYLTFQYVPDPLSLHRHIRRLPPGHRLVWTPGGGVREHRWFRPSLRPLRLQPAAAHRQIQDALRASVRAHLHADVPVGTFLSSGVDSSAVAALAAEAQPGIHAFTAGFAADGYSEIDVAQDTANQLGIPLTPTVVSDEQVLAELPRIVQLLDDPVADPSLIPLYFLARTASRYVTVVLSGEGADELFGGYTIYREPLSLATVDKLPPSLKRGLHHLAHVLPEGVKGRSFLERGTTPIEQRYYGNARIFDPEEKARLMRFTSAPHTEITARLYAETADVDEVASMQYVDLHTWLPGDILVKADRMSMAHSLELRVPFLDQQVYAAAAGLATELKLPAGSRTTKHALREAMRGIVPESVRDRAKLGFPTPTRLWLRGVIGDWVDQLLATSQTGHLLDLEYARGLLAEHRAGVADRSRKVWTVAMFCLWHAINVERTITPRAEKTVLSPRTPEGAGR

SEQ ID NO: 14170 - protein, 681 aa, Actinoplanes utahensis
MRWVRAGTPAWKSERVEIDLSEAQAPVRPRFPAALLRPEAEVVAFRGRHRLLDELGAWCSGAGFAALLLHGPAGQGKTRVAGRLAARLAAVGWGVHRLSDGDRPVPDGTVPTLIVADRAETRPEQIAGLLTACAAHDGDRPLRLLLLARSDGPWWQRLRTDPLLAGATTAELAELDDDPAGRREAYAEAVRDLGAALPRVPGQGGHLWSAIAARLAATPRDAGGHALTVQMEALADLLDAAQFGPAPTGRSAADRLLVHESRVWSFTAAWHGLAVDERILHDVLAAAMLTEPTDRLLDRLAGEHRDAVGAWLADLDTAGHPLAERFCALRLAARPALAEILVEDAPERVLSVLAAARHPGLTELCVRHADRLTPAVLTVAAAADEPEPLLAALVRISADPDTPVDRLTRIAEGLPRLSPLAAEVAQSIAERHRRAGDEAGLALALSNLSIRLGDLGRDGPALAAIEEAAVIHRRLAGQQPELYEADLARSLTSLSVRLGAVGQPEPALSAIAEATELYQRLTDREPESYRADLARSARNLALAFGGLEMFAQALTAIQESVAGYRVLAVEQPGVFLPELAAALSILAINLGSLDEDEASRAAAADAVTIRRHLADRRPDAFRPSLAAALTDLAVRHIVLGEAEPALAAIEEALTIRQETGGEDLDWSLHVKSVILGNVENR

SEQ ID NO: 14171 - protein, 235 aa, Actinoplanes utahensis
MLTVPCAPIRSIGSRLHCGNCRVNRSRTVSVLTGFAFTGPPCHAKLPVRKMPDKLARMWLRRLWAKHHEAAKFFMVGGICFVATTAVNYLLKLTVLHDKPVTALAFATVVATILSYVLNREWSFRTRGGREQHHEAALFFAVSAIGIGLNLIPLAVSRYVLELRVPDVSRPVQEIADFVSGIILGTLIAMVFRLWAFKRFVFPHAEARPVAAPRQRGPRTRVTRHEARRPAKKSL

SEQ ID NO: 14172 - protein, 300 aa, Actinoplanes utahensis
MSGIFRTGNFAWQGGPVNANPVSTDTVRDLLTRQFPQWSRLPIERIGAHGTVNTVFRLGDHLTARFPRHDTEDLLAEARAARELLGVTRFATPQPLAIGEPGPGFPRRWAVQTWLPGTVASENSHSTAISLGYDLAELVQGVRGMDTRGRPFRGRGRGGDLRAHDDWMAECFRQSEPMLDVGPLRALWAELRELPRESPDVMTHGDLIPGNLLTEGDRLIGVLDVGMLGPADPALDLICGWHLFDDPVREAWRTAVGGTGLDWARGRAWAFVQAMGLVWYYVETNPVMAGLGRSTLRRVA

SEQ ID NO: 14173 - protein, 595 aa, Actinoplanes utahensis
MSFRLRIFLLVLVVAGTAIGATAWLTLSLTSRELSRLNAARDRHKVEITTAIRRFGLTNGQWTGIDAVVAQLSRRTGLHIRVEGADITLADSDVIRGQAVGPVQLQPISIEPFPGLDPDTQADAVTIAQAARADPNVITTSDLKRLNRSQVEAMMRQRPALPAGLFTVTPRTSGLTTPEGKALLQLAQYRAGLVAVRCAAERHELTLPQLGTEQLPFLTPEQLTTAADCVRAGRNRVFADTGWLDEWWQQFVQCRSDPRYFDQCLEPAFAQGASSTSGIPVKVYFGAGRAQDLQGLGRPAVFGAAGLLVAAALGTAWVARRVSRPVRALTGASLQLAAGQLDVRVPAGGKDELAFLSASFNAMAEAVQRSEERQRRLVADVAHELRTPLSNLRGYLEGLADGVIEPTPELFASLHEETLLQRRILDDLQMLALAEAGDLAYHPEPLDLTELAETSVTAHRANAANAGLELILDAPEPVLVTADPDRIRQVLGNLLSNAIRYTDAGGRVEVGVSRDPLTAILTVADTGVGMTAAEVSRVFDRFWRADPARQRTTGGSGLGLTIARRIVDDHGGNISAASEPGLGTTFTVRLPAEMR

SEQ ID NO: 14174 - protein, 234 aa, Actinoplanes utahensis
MPAVTARILVADDDPKHAQLIRLYLERDGHQVLTVGDGRAALEQTRARRPDLLVLDVMMPLVDGLDVCRILRAESDPALSSVAILLVTARSAESDMLLGLDIGADDYLSKPVSPRELTARVRALLRRVRGGENREVLRVGDLEVDAPRFEVRVAGATVRLTAKEFAILELLAREPGRVFTRGQIIDKTFGFENDVSERTVDAHVVNLRRKIEENPAEPRYVQTVYGRGYRMGDR

SEQ ID NO: 14175 - protein, 289 aa, Actinoplanes utahensis
MAGARHRGMERSWGGRERLLFLGITLVATGPAWRLVPSGSPVADRMPAIAGVALLVAVVLIFPVSWAVLARGRTVGRRVGLILVALVAGWSVATVSAGTYETPPSVDDFLRWHLVAAGLTVLAGAAWSRGGGWGGVRLVGGVVWVSGVAVILAVPVVGQPPVPPGAVLPDGVVSLPDGVVAAGNRLDCNRARCTRVITVRAAGTGEARGLARRIGNHLAMADGWRMRWYPGFAEPDVDCRGSHRLADPYDLCLQLRAVGEPDASVEVRLYYRNRHDPVYRTASQDSHIY

SEQ ID NO: 14176 - protein, 373 aa, Actinoplanes utahensis
MERAFVLLKPDCLRTGRSSAVESVITAEGLRIACRHPLTLTPADTRLLWSEYTDEGHVLMRALLDRYLCTAPSAALLLTGPNAFEAARRVKRTIRSRYANGPFANLVHTAETPAELARQATHLFSRPDLPPVDHLGYTHSAPSDAASHRPTDGRPPVRHPAPAGGPPPVDGPAPVGGPPRVDGPAPVGGLLRVDGPAPVGGLLRVGGPAPATCSGECAPPFLSSDASPNAPRPTGRDFRQDADIPALVTDLWPLLQATDPPPPPPYHLDDHAQPTHPATRDDAALYLGADRAHSLDSAVTAIWSALPGITLPRALTLMLYASRVDGYPIAIGSHHAIAQSHRILLQHQLTACGIGPIHQRWASPIADQPAKKQ

SEQ ID NO: 14177 - protein, 340 aa, Actinoplanes utahensis
MLTSRSTDGGLTWSNPVITATGSLDKNWIVCDNTAASPHYGNCYTEYDVTSSGDSIRMKTSTDGGATWGSALAPGGSHAGLGGQPVVLRNGDVIVPYLSTTDTIRSFRSTNGGSSWNSTVAVATVSHHDVAGGLREEPLPSAEADAAGTVYVSWSDCRFRSGCPRNDIVIAKSTSETTWAAPVRVPIDATSSTVEHFVPGIGVDPSTSGASARIGLSYYYYPDSSCTASTCQLDVGFISSVNGGTSWSGATAVAGPMNLSWIPNTSQGRMFGDYISTSVVAGGNAYPVLPVATAPTGSTLHLGMSVPAGGLPVVGGANAAGAALAGQAGGGNSAVWRTAH

SEQ ID NO: 14178 - protein, 137 aa, Actinoplanes utahensis
MHPRTTLLSALALPAAAALLLWPAAPAAANAALTQVSTDPYTDTQAQHQSEVEPDTYAFGSTIVSAFQVGRVSGGGASNIGWARSGDGGTTWTHGFLPGVTTSGGGTFGQASDASVAFDASAAPPSTCSPAGPPTAG

SEQ ID NO: 14179 - protein, 1031 aa, Actinoplanes utahensis
MYRPVPAQVDLPTLDHEVLRFWQERNVFAESLRQSAGRPEWVFYEGPPTANGMPGAHHIEARVFKDVFPRYRTMKGFHVARKAGWDCHGLPVELAVEKELGFSGKQDIEAYGIAAFNDRCRESVTRHTDAFAALTRRMGYWVDMDDAYRTMDPAYIDSVWWSLKQIFDKGLLVEDFRVAPWCPRDQTTLSDHELDQGYEIDVDPSVYVRFPLTSGPLAGTTSLLVWTTTPWTLVSNTAVAVHPSVTYVVVTDGRERLIVAEPLIPEGLTPTGESFLGKELERWTYQPPFAMVDVPDAHIVILANYVTTDSGTGLVHQSPAFGADDLASCRAYGLPMVNPVRRDGTFEPEIELVGGMFFREANGPLVEELRTSGRLFRHEPYEHKYPHCWRCHTALIYYAQPSWYVRTTAVRDALLRENEKTNWQPANIKHGRYGDWLVNNVDWALSRNRYWGTPLPIWRCAAGHLTCIGSRAELSHLTNRDLSDLDPHRPFIDEITFACPQCEAESVRVPEVIDAWYDSGSMPFAQFGYPYQNAELFERRFPAQFISEAIDQTRGWFYTLMAVSTLVFDRSSYENVVCLGHILAEDGRKMSKHLGNILEPIPLMDQHGADAVRWYMAAVGSPWSARRVGHSGLQEVVRKTLLTYWNTVAFQALYGRTAQWTPSAADPEPAQRSALDRWVLSELQQLIAKVDSAMAAFDPHETGKLIAAFIDDLSNWYVRRSRRRFWRGDPAALATLHEALRAVTLLMAPITPFVTERVWQDLIVAVDPQAPSSVHLAAFPEPDTALVDHDLSAQMATTRRLVELGRTARAESGLKIRQPLSRALVSGGADLPPELLSEIAAELNVNAVEALAGSFVDTTAKANFRALGRRFGKAVQQVAAVIQAADAARLKDDLRTKGSATVTVDGEEVTLAPDEVVITETPREGWAVASDAGATLALDLHLTPELRRAGVARDAIRQIQEARKGSGLEVSDRIRLRYRAGGDTSLALAEHRDLVADEVLATDFAAGDPDWADPREFSDDSIGLTFWITRS

SEQ ID NO: 14180 - protein, 64 aa, Actinoplanes utahensis
MAVSPGQPTELRYADVGLRRLNVLWPTEGWELVAAVDHSAAAASETSYCTRKDVALCGTPSTQK

SEQ ID NO: 14181 - protein, 102 aa, Actinoplanes utahensis
MYACRNSAGEVKLRDSGTQPCSRTWTPISWNAKGVAGPAGPAGATGATGLTGPQGTTGLTGPQGATGLTGPQGPTGLTGPQGATGLTGPQGPIGLTGPQLAS

SEQ ID NO: 14182 - protein, 1763 aa, Actinoplanes utahensis
MQERPSPVAARSQTPRLQPPTSPVFRDKREQFSLSLSDVGLRRAATAVLVVVLAAVTMLTVGHAGAAVTSTFRDRFDANTNGSIILRGNSNLTCLLSGQPTCPQARNGTATGASANNNSYAMAYTDVDTNPLTFNDSLATLDMPPGSTVLFAGLYWGADSVSPLRDQVLFSTDGGGSYRPITAATLFPNGSIYQGFADVTAQVAGIGNGVYAVANIQASITSGSYAGWSLVVAYHNAAQDMRALRVYDGFGQVSSGNTNIPVTGFETPHTGTVHAKVGAVAYEGDRGTSGDSLQVDGRSLTDAQNPASNFFNSTVSESGTPVGGRTPGYDNTLGFDVDQVDATGMFANAATSATLTLTTTGDQYYPGVLTFTIDLYAPNITTTPSVVDLNGGGLVPGDTLEYRIAVRNEGNDTADGVVLSDAVPDYTTYVPGSLTVAASPVTDASGDDAGSYAAGAAGWTLGSIPVAGTTWVTFRVTVQPGAPPGYPITNLVNVAYSGRSSGVSVTATGATTASVVLQPHDDLAAALAVTPPVVQRAATPAAVTYTATVTDTTGDLEPAATATLTLPAGVTPGMMPTGCWAAGQVVTCALGPVAAGSSAHATVPATVSGSAAASPVATLRIGGTGADANSANDTATATLVVNSAPTVVADSAATSFGTPVTITVKANDSDPDDPMSALVYSVSGPPSHGVAVARSDQGITYTPAAGWSGTDTFRYRVDDPHGGSGIATVTVTTGNAPPVANDDVVNTPTDTPVTVDVLQNDADPNGDPLTVTAVTQPPSAAGTVTFTDTDVTFTPDPVFTGTTTFTYTVSDSSGDTATAVVSVDVENAAPTAAGDLFPVTYPAAQAGVVLPVTGNDTDPNNDPLTVTAAGQPAVGTGTTSLSAGVVTYTAPPGFSGVATFRYTISDGRGGTDSAAVTVVVANAPPVAQAFVTTTGYRTPRTLTVLAAATDPNNDPLHVSGATAPAHGVVTRDPTGRITYLPDVAFSGTDSFAYTVDDGNGGTDTATVTVTVANGLPAARDDAVTGFGGASITVDVLANDDPDPNGEPLTVAIDGPPGHGGAVAGPGGRVTYTPAAHFFGVDTFHYTLDDGSHTLVGATVTVTVVNVAPAARADAAIIDTNTAVVLPVLANDDDANGDPLTLTAVGTAAHGTVTANADGTVTYVPATGFWGTDAFGYSIEDPAGLADAATVTVTVRNAPPVAADDRFSVRPATPAGLSVLANDSDPNTGQVLTVASATTPAKGTLTLTGGVLTYRANPGTAGTDIFDYVVTDDAGATATAHVTLFINGVPDAVDDAVAVPADTAVDIAVTANDTDPEAQPLRVTAVGTPSHGATRINPDQTVEYRPAPGFFGTDTFGYTITDTADNTASARVTVQVANAAPVARPDTAALLSDRSVLVDVLANDSDPNPGQTLTVVAAGQPANGAATLAAGGIRYTPAVGYVGPDTFTYTIGDGNGGTATGTVAVTVSNGVPVAVPDARRTPYGRPITVDVLTNDLDPAGTLAVTSAGVPDRGTATFTPGAVTYTPPAGFSGTATLDYTAVDDAGHRTGATVAILVGVPPSVPNKQTTVRDGQLVRIGLPATGQDGRPVSLSGIGRPRHGTAVMNADGTVTYVPDPGFSGTDDFTYEVMDADGNVAQATVHVIVPPPPAPSPVPSPSPSGPPSPSGPPSPAGPPPMSPSPSGSSAPSASPSSSAPHLPRPSRSSPTPAAPHRTAPSGDTRPPTSPVTGPDAAAVALAGLCVLAVGATLCRLAGRRTGRPPTGGD

SEQ ID NO: 14183 - protein, 248 aa, Actinoplanes utahensis
MSDASGMDVTAYLDRIGADDPGLRELSRAHQRAVPFENLSIHLGETISLDPDALFDKVVRRRRGGFCYELNGLFALLLEELGHTVDRVACRVHRGDGVFGPLFDHLALIVDGEWLVDVGFGRHTIYPLRLGDRADQVDPEGRFRLVDAPDGDIVVLRAGEPQYRLERRARPLTDFAPACWWQQTWPESQFRRAPVCTRLDGDTRITLSRRTLLRTVGGDRVETELTSDADLLAAYRTHFGIELDRPIG

SEQ ID NO: 14184 - protein, 331 aa, Actinoplanes utahensis
MMTIDVPPGMVMAPASRATRGPVSVRHPEGSAVPLEVRPINGPGEIDLFNSLPYQLNPEIAGDLEAGRRRPQWLWIALRGGTVVARAGWWSRPGDALPALMDIFDVTDIDAGRHLLRTAMAAVPTGQYNRYLPPDWRETARAAAEVRESLLAETGGRLFVERLRLEWRPGTPIRDPGDRLRFRPPHGADELIGLMTAVLDGTLDAFSRDDLRRMTAREAAEQQYAEELARYGSPRDWWRVAVRADDGEPVGFVIPAHNGYHPIIAYLGVAPVHRGNGYIDEILAAGVRILADRDVPRIRAATDLGNTPMAAAFARAGFRAFEHEIAFTWPD

SEQ ID NO: 14185 - protein, 558 aa, Actinoplanes utahensis
MTALYDVDGVPALHAPGTGPMRAGLIFRVGFADEPLARHGITHLLEHLALHSLGMTDHHFNGTTGVEHTSFHLTGTPDEVATFLTRVSTALHDLPAHRLPVEKDLLRAEANGRGIDPKPLWRHGAIGYGTVSYPEWGLPAITADDLRTWAARYFTRDNAVLWVAGDRIPAGLRLALPPGRREPAPDPSNALPVTPAWFSGGDSVVAWDALVARGAATEVFADVLERTMFRQMRQEAGLSYTVGAHWRPIGSGQALVTAVADALPEKSGAALGEFLDVLATLRAGRIHPDDLSTVVRQRAQALWQAEQSGERLEAVARDLLAGLPVRSAEAEFRVYEAVTLPEIVAVAEAASANGLLMVPDGSYGGWAGFTHAPTASDTLVTGTAYESLNDPAERLLVGPDGISMIAPDARATVRYAACSIMRAWPDGARLLVGTDGIRIMVEPDLYRAGDDAIGWIDRAVPAHLRVDQPPRDPSALPTPAPARPAPASASASASASASAKRFNPKTQRTLSYVMSGISAGGVVSMQQHEPVLAALFLLLLILVTTGGHVMRRRLRHHM

SEQ ID NO: 14186 - protein, 175 aa, Actinoplanes utahensis
MQLGPAETRRRYDRMLAAHPHDYAGQAQYLQSLCPKWGGDWPRAHAWAAEATAAAPPGAAQGSLVAIAHLENWLELDEPEATAYLREEAVRDAVAQAAHRSVWHADFRREPGWVPAASAFAMAFSLMDERPAAGAVFAMLGRLAHRFPFSYLGGDPAAVVAGLRDRSLSPVGGVR

SEQ ID NO: 14187 - protein, 468 aa, Actinoplanes utahensis
MFRPRGCESGAIGDHPGCRAGRGGAHHHRMEHVPVVIVGAGPTGLTAALMLARRGVGCVVLERFPEPYPLPRAVHFDDEIFRVLAGLGLAAGLHAISRPAPGMQLVDPSLRPLATFDREPAGEHGFPQANMFDQPDLERLLRQALPHGALRAGRQVYDVEQPPSGPVLVRYRSVEGPGELTADFVLGCDGANSLVRSLIGSTLDDLGFTQRWLVVDAQGPDLSAYPGVQQVCDPSRAATFMMVTPGRYRWEFRLPVDRSVPSLLQPWLSGLPDPGALSILRTAEYTFRGALASRWRDRRVFLLGDAAHLTPPFIGQGLCAGIRDAANLTWKIAFVLSGRADERLLGTYAQERRPHARSMIRMAMLIGWVMTGGSRRSAALRRFLLRTVTRLPGAERRAMNVAWPAFHRGPLVGPGGGRLCPAALDESLGDGFALTGGLLIRPDRVVAAAGRHARKDFPAAAGIHDSGL

SEQ ID NO: 14188 - protein, 502 aa, Actinoplanes utahensis
MGRPASGHRAEPGRRGVQRLPAPPGLSGGRADHRPAARAAVVPGRGGGALMLADALRGLPDGFAGTLALVDGVDDTLTQGLARADPAALEALVPAFAGSPLAERVTEAIGKIVAGTVTDEHLLTLAGARTALLGAAHDALRDSLDTALGRARAPWSATPAATDSGQVLAGARSWLRELAIAGWRGVDHELAGGAGPAVQTLLADPGARRLAVLLDGLAAELRTAAPVATLPRIPVRRWADLWTRALLLAQPGRPAFAATPVDGRLLLLGVDLHEHPTVFQAQAHALLETADGAVRLVRTSVAAAKVDTISGPAAWRMLTAFPTLRRALAEHRVVEVAGMALTPGGDLIWDEARATAGAPADPFAAARVRLGTAAALPVTPLDRHPAALAEPVLLEGYGHTDRAFDLGGGVTLAVDLDRLPAAGPLTPELVAASTACLGLLRWDGRWLLQPLAVQTLVKKKPVAVHGGDWALGPTEAKAAKAEAAAGTAVDVLRERAGRLLRK

SEQ ID NO: 14189 - protein, 489 aa, Actinoplanes utahensis
MAAAAAGRADAGEEEAGGRARRRLGARPDRGESGQGRGRRRHRGRRVARARGKAAAEMSAAENRRQVLYWRLLARLFDPEEQATLESASMAVVDDLGLPAALLDPAVSVDTVVQRFPHLAAEFDTLMSDPGDDREGEVRRAALVSKLLLNVFATGSGSVTAGQLQGWQADAGWFERAMGCEPGRLRGRSGEGEDGLGRVLAGIEGDLISRMRLREVLADPRLAGQLTPSMSLIEQLLRDKHNLDGVALANAKALIRRFVDEVAQVLRTQVAQAGAGTIDRSVPPKRVYRNLDLDRTIWKNLPNWSPDDERLYVDRLYYRQTAKRVEPARMIVVVDQSGSMVDSMVNCTILASIFAGLPKVDVHLLAYDTVALDLTPWVHDPFEVLLHTKLGGGTNGTVALDLARPRIADPRNTVVVWISDFYEWQQQAVWDGMHAIHRSGVKFIPVGSVSSGGHQSVNPWFRQRFKDQGTPVLSGHIKKLVAELKNFLV

SEQ ID NO: 14190 - protein, 370 aa, Actinoplanes utahensis
MSDMLRAPAEVKYADELDWLESVDDGPKPFSWRLSPRMVRLFILGSERADGLDREIPQKWFGDRSFVERAIVTLASDRGLLLIGDPGTGKSWLAELLAAAISRNSTLVVQGTAGTTEDHIKYSWNVSMVIAKGQSRASMIPSPIMTAMEGGVIGRFEELTRSTSDVQDALISILSEKYVSIPELDDDNIVFAKPGFSIIATANSRDRGVNDLSSALKRRFNFVRIPVVTNRKSEAEIVRFRTEELLRRHNIELEVPPTLLDVLLQSFADLRAASAAASSDDERLESALSTAEQIGVLEDAILHSNFFGARTLTSQALAGSLVGSLARRSPEDLAILNKYWHGVVEPRSREHSGEWTGFLEGGRQAIATLS

SEQ ID NO: 14191 - protein, 671 aa, Actinoplanes utahensis
MKADRHHDRLGGGTARRGSGQPDDAPAARWRRGALATYYVALTVANLMLLSGVARVVLSGLAAATAVLLFAAATLGAVRRGFGRPGRAWEKLAYLPMIDAVAQVAVTGELHHTTTLLLTLVGVGGAVPDRRIAMRAALLGCVGWAAVVMLQHGLRTPELGFYGGQLLVAVVLGAILHEALRRRQRDLKSARDQLAVVLARFESLFQASPAGVAVADEHGMLVAVNPAFCDLVGQPASELVGASAHAYLTPDGEGPVAPEPGDGGHPASAAAGAGVAVDGGQESAAGRSMRFVRPDGSVRWVWLTVGRTGAPDRSDKRRWMLLHLHDVTDRHLAERALRESDRLLAAVSVASRRIRTRQDARGTIIEAVRELAEADSVTMLEPDGTDLVATGGVGVPVIGTRVPMDGTSMIAAVYRDGQPVFLADPGKDPRVSAALLRLVDASSMMWQPVIADDRVVALLVVSWQARISSVSDLRARAVALLADETALALEHEGLLGRLERMAYTDMLTGLSNRRAWQAGFAELLVAARTDGRPLTVAIADLDHFKRFNDTYGHLAGDELLIATASAFRAQLRSGDLIARWGGEEFVVALPDSTAQEAAAILDRLRESTPGTETCSIGYAVWDGAESCERLLGRADTALYAAKAAGRDTVRAADPTGCDTQPGPVGITAARR

SEQ ID NO: 14192 - protein, 124 aa, Actinoplanes utahensis
MGLFTVAEARAELARLRPVLDEIVTLRADMVELSAALVPGGEPTTLGGLPERKAAEARLNELMTTIQESGAELKGVAPLLLDFSADLDGSPVLLCWLEGDTDLAWYHRPDLGIAGRRPLPPDAA

SEQ ID NO: 14193 - protein, 60 aa, Actinoplanes utahensis
MGAGEIAKRLGLSRQRVQQLAERDDFPSPFDELAMGRVWLIPDIEAWIRQQRTGAPPPDR

SEQ ID NO: 14194 - protein, 156 aa, Actinoplanes utahensis
MGGMEFKVHALPLDVLKRARQDSVGGQPEVVRIVAGGGEPLRCCLRDALAGEVLVLFPYAPPIPPSPYREAGAVFAHAAGCTGPAGDGYPHGWRGRPQVLRAYDPRGWIHPNTRVHDGTDPEGVLAEMFADPDVVQVHSRNVAYGCFMFAITRAAT

SEQ ID NO: 14195 - protein, 808 aa, Actinoplanes utahensis
MLPAQTDRPRLRVVIGHAPDGSPVHLDLREAVDGGVGPHGLITGSLSGALLRSVLLGLATAHTPDEASFVLVDATTDGTLAELERLPHTEVLLDARPFAHSATPTTATPSTTAPPATAAPPAAPPVTSPFAAVPIAPPAAPPATAPLAAVPTAASPPATAFAAAAPGGGSLLPGGSGLSLLPRLVEVLEGELARRKRMLVAAGCRSHSEYLRQVGGRVPMPALIVVCHGFAALFAASPALLEVIRQIGWLGRARGIHLVLADSGTETPQTYELDGYLSYRITPGLLRIGTDQRIPFQPPAHAAVTIDHAAPGPAHPIWLPPLGPAPALDELGGAVVSDPDHGLRFADETLRGALQVPIGILDKPREQARDIIWLPVAGHVAVVGGPGSGKTTILRTLTASLALSHTAPEVRVLAPEALDCRRISLVRDIRDDLKRELYARLDDPHGDTVLLIDGWAEFWDEHPNWHDLLVEIARKGAGRGVHLVATASRWTEFPPAVTDHFGSRLELRLDDPAASAVHPAGAATVPPARPGRGIIPAPGGYLHFQAARPVLSRSHGPAIHPATAATRPKPTPTDAHPGPPTRPVPANMDPGLPTQSTPTDAHPGLPTQPTPTDAHPGAPTRPAPAAGHPGLAVGTEVDLLVALATDHCAECGFTHATVAPAALPGRLRAAGSLFAAALLQAGDLRLRPAPAVWSPLEYTCHVRDVLRVQRERLALALAEDEPVFAPMGRDERATLDAYNTQDPHTVLSELDQAAAALADAFAALAPEELRRSATYSWPEPATRSMLWVGRHTVHEIVHHLLDISRSAA

SEQ ID NO: 14196 - protein, 558 aa, Actinoplanes utahensis
MHPVVDGLPRLLAWRRVREFAVPPSMIETATARRLVGDWLGACAAARVEVNLDLRAVARRHGRELAAGIRADLRHLAPDLLRWHFPRVESGLLRPGLTVALARYGPRLVLVARTAPAWADADQRLTLSLWGGTGDEARGDDSRVHPHPRPHRRFRLDLHRHLWDARHAAELHERCGAATWPGDPDGLAMHRWQAEADILRRAEAAYARSAAAEASSFGVAGQAWSAAAEASSFGVAGQAWSAATEAPPGHFRQAVAPADEAVLVRLHARDIRQLLPAAGASAGGGGLLLPDAATRVPPDLELLRAGLIEPGHLHPLVAESLAPGSHVRAVAAGDSGPRLVDCRGQRHRIELVDGVLSAIDHHPDELRREEILVAFGGPPLPCLRVIDDAIRHPEDLDDIRARLDHGNLAGAMRAVECLLGPAAVLRDGPLRDELERAGQRYVTYGLYRSGLAGRCPPPDDPLPRARRRKRIERNTAAKKDSYAAAKKDGGTPAKKDGGAPAKKDGGAPAKKDGGAPAKKNSNAGTQARTARRPRRQETWPRRTEPETPRAEAPQRPLR

SEQ ID NO: 14197 - protein, 388 aa, Actinoplanes utahensis
MTLDIAAELIGLLADTTTEPRPDIQLEALTLAVAADLPVLLWGEPGIGKTAALHQLAASLDLPLTTVIASVHEPTDFSGLPVIGADPATQGVPMAPPDWAVRLANSGRGLLFLDELSTAPPAVQAALLRLVLERRVGALTLPPGVRIVAAANPRGSAADGWELSAPLANRFVHLQWTFDHEVVVRGLGGTWPRAALPRLDRARLAQAVTYARKAVTDLLTVRPKLVHQIPQSESKRGGAWPSPRTWDMAVRLIAFGMAAGTSREVLSMLVRGVVGDGPGLELLATLDRMDLPDPEALLADPVGAVLPERGDLRQAVLDGVVEAVRRNPDRDRWDAAWAVLVKALATGAPDLLVVPAGNLAELRRDDWPLPAGIEQLAGAVGVARLAGR

SEQ ID NO: 14198 - protein, 397 aa, Actinoplanes utahensis
MRLSEADTEKLYAARLFAVRARPYLASALFALTVVESPRTPTMAVDRFWRCYVSPAFVARTPLAELASVWVHEVSHLLRDHHGRGDRYARERDLRGPGERLRMNLAADCEINDDVYGDGLPCPPGAVRPVDLRLPPGLLMEDYLGQFRLGRHTDAYTWFDCGSGADGAEREWDLGPDGAHGLTDQERDAVRFRVAQSISGAPGNVPDGWRRWAQEAFHPPQPWRELLGAAVRAAAGARGAGEDYAYGKPARRAASLPRVILPALRRSPPKVCVVIDTSGSVSDEELGTALLEVAAIGRAVGGRRGLVSVVACDAAAGVAHPLCRAEGIPLIGGGGTDLREGFRQALRTRPDVIVALTDGWTPWPSRQPPCRTVIGLFRRREPLTQWPPEWARVVKIG

SEQ ID NO: 14199 - protein, 707 aa, Actinoplanes utahensis
MVANVPLTDALSVQAQNTAAVLPTTYAALSSSVAVAVPQPSLSVLLSSTVSDPTRQNAAAAGDLITYGYTVTNNGNVQMDSIAVADTKGDTVTCPHPTLAIGDSMTCTASPGYTVVQADVDAGVAVTNVATVTTVPAGGGSTVTFTSPAGGVQVAAAVPALRITVAASTAGPVRLGDTIGYDYTVDNLGNVKLDNLGVTDAKAATVTCPATVLPAGATMGCHSSSTSYTVGQADIDAGVPIRNDAIVDALSVAPGHMPASAESNAPVPVVAAAPALTLTSIPHVTPAGHAAAAQTGDQVYFTYQVHNGGNVTMHGVAITDTLTGPGTCPNVPLPVNTTMSCTGGPSYIVTQDDYDAAAPLSGTARVQARAPGVPVPGTYDTATAGVPVGSGNAAAALATAALRVLPAGHQAAVEAGDRFAVDFTVRNTGTLTMRNITVSDDRAGTATCPGTSLRPAASMTCTTPTYTVLQSDIDRGEPLTSVATLRGQAGTGAVQTYGTAGTWLAVTRGVPSLDVRVVGTVSPAAHRDAAGVGDGLTWTFQVVNNGNQTFTAIAATGTGTITCPQDRLTVRETMTCTSDRGHTVTQEEVDAGKALGAVVTVTGTAPDGPHRFGPVDGTVAVVAADPRLEIAMTTRVTAQADMVEAEEVDTGVTAGDLLRYTYKVYNRGNVTVGSLSVVHARAPKISCATGSSPPAPVPTAWPPTCTG

SEQ ID NO: 14200 - protein, 137 aa, Actinoplanes utahensis
MALRVDLTFDCVRAQELAEFWKAALGYADEPPPPPFRTREEWVASFGEPAEDAGGGAWLHDPEGLGPRLCFLEVPEPKVAKNRLHIDVRVGRYGDPWPRILAKVEDLRAIGGRVVTTFDGHHVTMADPEGNEFCVAA

SEQ ID NO: 14201 - protein, 178 aa, Actinoplanes utahensis
MWHCPRMRIEAPSTALIAIDLMPRIVSQNMGPHSGADVVARSLALADAVRAAGGLVVPVRVERPGVAEQPPGSGLVPEFTPRPGDLEIVKRTIGAFPGTGLEQALRDRRITTIILTGIATTMGVESTARTAADLGFDLIFAADAMSGMTETEHHHALTVTLPRFGEIRTTAEILARLG

SEQ ID NO: 14202 - protein, 274 aa, Actinoplanes utahensis
MSATVAKWSGMVAVDDTRLAVTDTGGAGRPVVYVNGQFSTQPYWRRVVRELGPQWRHITYDERARGRSERSGDYSFAAWLRGLDAVMTARGVARPLLVAWSYGAVVAAHWASLHPERTSGLVLVDGAFPYDWLDDAVEQRIRKLFRRINRCAPVLRPFGLLPRMSAEQQAESNIELGRLSRVAELGPVLDGITVPVRYVVASGTSLGSKGDEQEQIRTSLEQVLVRNPNIEVSAKVPSNHGAILRRNAAEVAAAVREVAASAGTTGRGGSMFPL

SEQ ID NO: 14203 - protein, 371 aa, Actinoplanes utahensis
MPRRSRRRCGRSRRRRARRAEADRCFHYDPPMIRTARLLLRTIRDGAVPAVPEFDAERALLDKGLWETRRDVLRGEWESARELIAAAGDDWELRGTRILSLGELAVADGRWLDAWREAHPDDPAATLMLSARIREQARQARGSASAAHTTAQQFADFHRLSEETAEVVRRAIDLAAPGDPVPWVQLLGTLYAGPRGRDGAIDEVFEEGRRRDPGNFDLHLHMLSLRCRKWYGSHERMFAIGREVAETAPDGTNVVLLPLFAHFEYAMQEYGWDKRSAAVLRDCRKYFRRTEVRQEVDRCIAKWRAGTPSIGRLGTCRHWVALYYTLTGQRKAARAAFAEIGKYVDPAHAWAYFHPNREYGFFQGWRWANGL

SEQ ID NO: 14204 - protein, 457 aa, Actinoplanes utahensis
MSSLVEVTKPARRDAATGRTVAIVGGGATGALLARALIRRTHQDVVLIAPDEVAGRGVAYGAAEPWHILNARAGSMTADFDDPLDLVRWCTARGRPTQPCEFLPRSVYGDYLAERFTETVLESAGRLRHHRATATALHREHGGYVIVTDTGPVRADQVILAVGNPPAARLPGIDDAAYSHPLFITDPWAPRPELPSDAPILLIGSGLTAVDVALTLDAAGHRGPIESISRHGLLPQAHPVNAPAQVRLDLPADLTLRRLLRQVRATVDAGADWIAVVDELRHHADEIWDSFTEADRDRFLRHVVRYWDIHRHRMAPPVAAKIADLRRRDRLRFTTGRVTAISPDPAGGLTVTTTAGPRHFAAVISCTGPGRLPGSATANPLLAALFRGGGIRTAPHGLGVDTDPDGRVYDAIGRIRPGLWLAGPLRRGRSWEATAVPEIRAQINRLVTALTLQPAAR

SEQ ID NO: 14205 - protein, 411 aa, Actinoplanes utahensis
MSDIDVVITGWGATTPLGGDVDTLWEGMLAGRSGARRIDDRVQNYRHWADLPTLIGAPMAVDPAGVLPRVQARRLDRCEQAALVAANEAWQHAGAPEVEGERLAAVIGSGIGGVGTILGQDDLIEEKGPSKVSPLVVPMMMPNGPAGWVSIEFGAKAGAYATVSACASGAEALALGARLIRAGEADVVIAGGAEACIAPLTIAGFAQARTLSRRNDDPERASRPFDTDRDGFVLGEGAGVLILERADFAAARGATVLGRLAGYGVTSDAHHITGPDPTGSGQIRAIRNALRTADLTPADIDHVNCHATSTVVGDVGEATAIQAALTDDVVLTAPKSAFGHLVGAAGAVESIITLLSIRDGVIPATLNLENKSPEVKLDVVAGEPRRTDLRAAICNSFGFGGQNVSVLFTAV

SEQ ID NO: 14206 - protein, 242 aa, Actinoplanes utahensis
MPSQRVSTSPPSGVVAPHPVITTSMSLIGFPYPLRRLAFHSCIAYKFGVSTAEPVRARGRQTRTAILESAAELFAGRGDLAAVSVAEIATAAKAHPNQITYYFGSKDALFVQAAFRLLLRDAVRLEPVGMRQRTPASFRIALARTALALPTVPLAVQAMAISRMRSELHVQAQQSLTVLFRQAEGYLRRILHRRDWITDRPLDIEARTFWIAVFGARLVSESGFGGQSADVDLAGVLTVRQR

SEQ ID NO: 14207 - protein, 105 aa, Actinoplanes utahensis
MLGAAPPPVHYHRDHAGRVLASALPLNASAVAADYDYPTSDIDDVPLLQINGDGVRARRLDSADLTSVGLSPSTGSSPVEIASARVGTWSPTRSRCRLTTTSSGC

SEQ ID NO: 14208 - protein, 377 aa, Actinoplanes utahensis
MQLTRALPDATLTTRIAETIKVPGTLPKFPWPAQGSAELMVQGLGRIGGSGGQKAEPIGSVAKVMTAYVILKDHPLDGTDEGPALTVTAADVADYNARIPGGQSLVKVVAGEKLSERDALEALMLPSANNIAHQLAVWDGGTVNGFLERMNDAAKDLGMSDTDYTDPSGFLPTTTSTAADQVKLAQAVLKFDVFAQIVELRSAQIPVVGTIQNYNALLGVDGVFGIKTGSTDQAGGNLVFAARLPVGSRTLVVVGAVFNQPGANTPEQLAAVNRVVRKLLAQVRRTVKEYQLLAAQAVGKVTTAWGAEATVTPAGPLKVLGWPGLAIPVRTTVTKPGPRVTAGQPVGQVQASGVRVDLRADAATSDPSLWWKLTRKP

SEQ ID NO: 14209 - protein, 325 aa, Actinoplanes utahensis
MREESSATARGTVTAGYALGALGVLAFSMSLPSTRLAVHDLDPWFVAFGRAVGAAALAVAYLTVTRAPRPTPAQWRRLPVVALGVVVGFPLFTSLALTSQTSAHGAVVVTVLPALTAIFAALRAQERPPLVFWLASGGGLIAVLGFLATTGTVHGALTPADLYLLAAVVLCGLGYAEGGALARDLGGARTICWALLIALPATLPITVVTALRHPPHTGPAGWVAFGYLTVVSMFLGFFAWYAGLARGGIATVGQIQLAQPVLTLIWSALLLGEPVTATSIGAAVIVLGCVVATQRTRHGFRVSFHHSEGSLVAASARRSTRTPEA

SEQ ID NO: 14210 - protein, 202 aa, Actinoplanes utahensis
MDAVRDAGAFLIEDDYARDLTIDGDPPAPLAAADPDGHVVYLRSLTKSAAPGLRIAAIGARGPAGARLRAARLLDDFFVAGPVQQAALDFVTGPGWVRHLRTLRSDLESRRAALVRALERHLPELAPAVLPRGGLHLWVRLPDGCDDVAVTAAAAAEGVVVFPGRPWFPAEAPAPHLRLTYAAAPPDLMDAAVRRLARAFPR

SEQ ID NO: 14211 - protein, 278 aa, Actinoplanes utahensis
MQSDFGPRAGMRLGDRYRLQDRLGAGGMGEVWRALDESLNRLVAIKMMLPSAAQDPDFVRRFAAEAMAMARVNHPAVATVHDVRQAHGLTFLVMEYVDGESLAQRLAREGRLSPAETMRIVTRAAEGLQAVHDQDILHRDIKPANIMLRRDGEVLITDFGIARHAGAAGLTATGAVLGTPSYLSPEQVLGQPSDRRSDVYSLGLVAYECLAGEKPFAGDNPYAVALQRVRHEPRTIGGGRAGAGTRPGRARAADRPGTSLPVGAVDGRGGPAGGHGGR

SEQ ID NO: 14212 - protein, 216 aa, Actinoplanes utahensis
MPGPVLALVERALQTDPERRFPSALSMAEAARQVDTAAADPRTASRRLSNRALVAAAVAVVVVVALGAAFLPRGGHGKPEPAAAEPAAGALPDGFAACGAGICPAQPMCWSGLTQIGAQALPPAVAYCPGTHVWETFAVLRLPAGPPVMSADAPLIEQADVAKACSAAELAAHSIDPGRTRGWRRDAWPVQSGTGWLLHCMAQPKTGSSVGAAFRA

SEQ ID NO: 14213 - protein, 163 aa, Actinoplanes utahensis
MACRGVWFALTGSQDRELVEAPGDAEVRALVTDLEAAWDWDFLCEADKAWDALHRCLGDGTLRFGKHGGVLALTVLGGGLHHDGPDYIVARVRADQVPAVAAALAAVDESWLRERYDEIDPEDYQGVLDDEDFRYTWQYLQDAREFYRRAADAGRSVIFTVDQ

SEQ ID NO: 14214 - protein, 319 aa, Actinoplanes utahensis
MSPSRRTFLAATTAGVLTAGGALGVSPLSAAAAESSPVGFASLNGGTAGGSSSTVVTVTSASALKSALSSGTSQTVRISGLITISGMYRVASHKTIIGVGASSGVTGGGFTLNGVKNVIIRNLVFKNAGDDSINLQDGTTNVWIDHNDLSNGYDGLIDIKRGSDFVTVSWNHLHHHDKSMLLGHSDDNGAQDTGHLRVTYVHNWFDGTNQRHPRVRFANPVHVLNNYYSNIGAYGVASTENAGVFVERNYFENVDHPTVTQTGDSDPGNLKVLNNYRVNSGTEEVRNGGSVAAIPYPYTPEANSSVKATVVAGAGTGKI

SEQ ID NO: 14215 - protein, 328 aa, Actinoplanes utahensis
MSHSRIVAGAVAVSVVLTPVAARAATSFTVAADGSGDYTTIQAAVAASSAGGVITIKAGTYQGQVQIPASKSGITLQGATGISADVIITGNKPQSTAGTAGSATVHNLAPNSTIKGLTMQNTYGAGSQALALYAAGDRQVYRNVQLKGYQDTFLSWGGTGSSQIRQYIYKSYISGAVDFLYGNGAVVIDSTTIESLNIGSSANNGYITAAATDDSNAYGFLITRSVLKSTAAPQTVALGRCWHAGGAADAIGQVLVRDSSLGSHIRQAGAWQDMGGFSWRTCRFTEYADSGAGVSTGTGDRPQLSAASAANCTARRYLAGSDGWNPVQ

SEQ ID NO: 14216 - protein, 145 aa, Actinoplanes utahensis
MLNRRVTNLVLTATLAAAGLMAVPGPAPAATAIPGPVPAGPALAAVPAAASPVIAAPAALDSSRRVGVFAELYRGRLIHGWGGAQPCAYIDGVSLGLVSHGDNRYSSTVNAYEVTVGVRETTRAAVRSLAGDELQPTEPPAYCSR

SEQ ID NO: 14217 - protein, 273 aa, Actinoplanes utahensis
MGVRKNARNLTSTEKAAFVSAVKRLKAQTTGRNYDWYVTTHLNYFAAVGGVRYAHQSPSFLPWHRQYLIEFERALQVYEPSVTLPYWDWTVDRSTTGAPFTADFLGGNGSGGNGPVTTGPFAGATNWRITVSSTTATSLRRAMGSNSLPTAAQVSSVLGVGTYDAAPWNSSSTSGMRNRMEGWTTPNLHNAVHVWVGGHMGQQDSPNDPAFWLHHCNIDRLWSQWQTRWGFDAAHYLPAAGTSGVVDLDETLQPWTGVTPASVLDHSGVYTYA

SEQ ID NO: 14218 - protein, 158 aa, Actinoplanes utahensis
MSTLSRRDVLRYAAAATVVTGGVAGAQALSTSSSSAQAPAGARTSADPRDFDVEYRGKRITGVHGADTPGALRSVSGSRQPHQVHINGRRLAVMQIELPAAGGGVTLGFISALNHYEPVLIDTDKNRDGLLKLTRRAVDALGDSELTALAGADHNHGN

SEQ ID NO: 14219 - protein, 139 aa, Actinoplanes utahensis
MNAKETQKMRKLSVAALVATATALLAPAAAQAAPATTTALLGTYGFGRAAVIGDAGTAAGVWRAPVVRSGFAGDDLTVTFTPRTTPRASEKLVYTAAFNEVADAQAECRKVGADGVARHVWVSFRCQTGFVPSYTLYVR

SEQ ID NO: 14220 - protein, 293 aa, Actinoplanes utahensis
MSMLIYLDCDTGIDDALAIAYLLGHPDVTLAGIGTVNGNTTAPQAAANTLGLLALAGRDDIPVAVGSGAHPYAVASVHGGNGIGGVRVPAGREPDPRTAATLLIDLARRHPGQLHLLATGPCGNLAAALAAEPDLPSLIASVTVMGGAVRVPGNRTPRGEANIIHDPAAAAAVLAADWPVTLVPLDVTMAHRWSTGDVASLRATGSPLHVALADMLPAYFDGYAEQLGVREIPLHDPLAAAILLGEVTPADAPRLSIAVGPDGHTVETGPGPVRVVLTLTAPAAPALLHRIAG

SEQ ID NO: 14221 - protein, 267 aa, Actinoplanes utahensis
MRRELRIYLMLRGAALRGVLQYRGNLVWMLLAGAAYQGSGFAFVWALLHTFDTVGGWGLGQIAFLYGMRLLSHALWLITMDGVGQCDSAIREGLLDRMLLRPANPLVQLASYTRSVLPFGDLSMAIVLFGVALTVTPVDWSPGSVAFLVLAILGGALLEASAVVTVAGLSVRVLDTWAYRMLVFDAIDTLGSYPLSVFGGGVQRLLTYVLPVAFIAFLPAGVILDSTGGLAVPAWLGYLSPLVGAGLFTLAYRFWRRQLRGYQGIGN

SEQ ID NO: 14222 - protein, 283 aa, Actinoplanes utahensis
MTLNAMVRRAAGGYGMHARRAARAYGAYVRTAIAIRLQYRSTLFASIAVTLMWIVLVTRVWSAAYRGREVVAGLTLQATVVYLTLANLQAMIINSPITWIMANRVRTGEVVFDVGRPLGYPGQMLAMQAGQSVIQTAAMVIAAPVAGLLGGLSRPAGVTAGLLYPVALLLGWVMNALLTMVVGMTAFWTVDNLGIAVLYRFIAAFLAGASVPLTFLPGPLRAFAEALPFRFIVYEPAAIYIGHRGGTAALRGFAVALAWIAVLGVLVAVVWRRAYRKVVVHGG

SEQ ID NO: 14223 - protein, 245 aa, Actinoplanes utahensis
MVPWRDRKRLAHRIGVVFGQRSQLWWDLPLIESFRLIGALYDVPAERYRSNLARLRELLELDPFLQTPVRQLSLGQRMRGDLAAALLYDPPVLYLDEPTVGLDVLAKETVRGFVNEANRSGRTTVLLTTHDLADVERLCRRILLIDHGRVLYDGPVDGLIARYAPYQDVLVRLDGDQPDGDRLVLAGFVGEREHDGRWRFRVGRDEPVHRLLTAAGDGRQIRDLSVVESNLESVVRELYRERREA

SEQ ID NO: 14224 - protein, 332 aa, Actinoplanes utahensis
MPAGIADAFGLGRVVACRVVTTGFMNLTWRLTTDRGEFAVKRLTDRSPEEFEDIQNLLPRLAERGFPVPLARRTPEGSALLKINNYRYAVSDWRPGEHPSGAALPLDACAGLGGLIARLHLTLGDLLPAAPTHLADTPASVDEARAALRHYAALHRRTAHPARMTHQEDLAGEIDRRLVLLDAIADRRPAPGRVGPCGWTHGDLQSFNLLMAGGRVTGILDWDRMGVRPYAQEVVRTATILFSDGGRTALDLDRTTALIRGYCARLPLTRAAVIDAAERRRWTLATETWQLQRHHDDGDSTCDRLFTARGRFLRWWTENWEEVMRAVCAGCS

SEQ ID NO: 14225 - protein, 141 aa, Actinoplanes utahensis
MRLRLRHLRHGSRIFTWRAEIHHVPGSADCHRCIRVRAWGAGKNGQALQADLLSVAWGTPWSACSTDGSHPGPADIRAMIVYALTAGWQPERRGGTFPLTEAQHAETFRLPDFLLTDRLRTPCSGDPTERVIAAHDLRQRS

SEQ ID NO: 14226 - protein, 208 aa, Actinoplanes utahensis
MSGTGVAAMMVAVLLLSACAEQAQRTVSRASPQAPGCGHDAPVPDGVTLLAEDVWAGGGTTASRLRVLPAEACSGTARRPEECDTFPWAPERGLYPLGGRAWLSVGMAKNGNDKADPVREELLLYAPGSHFAQTSAQAALDCGFTVLTVLDGKPATLQRIGDRLTEIVYITPRSVIGMSSVDPSVGPADLVWLAGVAADRSAALTYAS

SEQ ID NO: 14227 - protein, 473 aa, Actinoplanes utahensis
MPADTTYLELSEDTGSAHKFYEVTVDGTDLTVRYGRIGDRGQVKQSSFTTPEKAKAEASKKIGEKVRKGYAPAVAGGRARRAVSRRQIVSTRSTATRAPILWRYASGSPAFGIFIDDDVCMVGNERGLITTLGHDATVLQRFQLPDGVKCIVADDGWIYAGCDDGNVYDLSGKIPRLAYRIAPEIDIYWLDIHDGVLGVSDAKGGISAIDHEDEFLWQRPGRGSSAWMVRCDATAVHHGHSGGVTSYDWRTGREMWHTKTGPVLFGWQERDTLYAGTATRQVVELGKDGAQRQMYQCDAAVYSCATAEDGRYVFAGDSASSIYCFDTNGTRLWKLSTGCGSAYSMQYRDERLYIVTTDGSLACIDASETAIRAAIGGTVPQAIDVKAPPQMPAVVPSTTVEVIHDATDGVLVECVEAGGRVRVRVLSSGYHADWQVQFPKGIREPGSRFVVTGVREAARGGFYRAYGDVRRLL

SEQ ID NO: 14228 - protein, 212 aa, Actinoplanes utahensis
MTIYGPGGVDVRDPRRRLHPGVLALVITAVIIIVAALAYFMMRSPADPTAQPAAVPSRAAAIAPSPASSPSPTDPSGLTTGSWQVTAADDRDTYLTVAGDFAAMSEVAATITVVEGLADDSCFTFRDEDGNFLRHYNYRLRFDPKDDSDLFRGDATFCAEDDQPGNSFRVRSKNYPDYFLHRRGTKLYIDKPSESDDFVADSTFALHTPTTS

SEQ ID NO: 14229 - protein, 438 aa, Actinoplanes utahensis
MSGFGAANRALVAGCLALTLTLAPTLTGCSAASKPDPAGSTPDVGGADRTPEAGRAESTPATGTLVTTTVTGTDHRIQAPPGWSVQLWAELPGARLLAWTPDGRLLVSRPGAGDVVALTPGPPGTKPRQTTLVGGLDQPHGLAFQNNTLYVAESDQVDRFTYRAGAVSGERVVIAGLPDAKSPELGGAYAHALKSVAIGRDGTIFVSVGSTGNVSANDREARPQRATILQAPPGGGRPTVFARGVRNGTGLAIAPDGSVWTAVNNRDNIADPSDGQVKQSYVNDHPLEPLARLTPGRDLGWPYCNPDLDRRFVRDYQLNRDGAKLDCAKLAPIEQGLGAHSAPLGLSFATLAAPFGQGALVGVHGSWNRTPPRAPEVSFFAWRNNALGPQQTLLGGFQDARGNRWGRPVMAVQGPDQALYVSDDLAGAIYRVQATATS

SEQ ID NO: 14230 - protein, 494 aa, Actinoplanes utahensis
MQPWREATLMRNRLRAAVLASLVACSGLMGVATPAQAADATTLAGRLASVKVAKTLNYYPSSAGWSAMWTNFDPVAIDADMAKAAQLGATNIRAIVFPDAFGYPAPKVEYTEKLRKFISIADSYGMTVKLTLFDWWEGYSDASRSIAWAQAILDPYKDDPRVLAVELKNEFQPNDATAIAWVQQVIPAVRAAAPTMPLTLSVDGGTGATGMAQIKAALAATPLDYYDFHFYGSSERSLAEIRKAQAAVSPAPIVIGETGLSSGATSEGEQAAYLARVLRAATEAGVGSVAPWTLNDFAAGAIPSQSQVSAIPAQYTFGLYRADGTAKLAATVVRTAWTTGTVPNSYLNLGFEAPANELTWKANQPDAGVGTVSTDMPRNGRYSLKFAGTTRTSSGLPSMRTSPITPVQPNYRWRAEAYARGFNATGITEISLSWFDANGKWLSETTSNRLPLGNTTWTKLVVDTVAPAGAAAVQLHLKSADNSGIVYFDDVAVS

SEQ ID NO: 14231 - protein, 435 aa, Actinoplanes utahensis
MQSRTDLIEDLMSRFPHVPREAVIKEDLLRGGLAFDDAALTDNEGGDVKPKSYFIFSFDHRTLPELGEAALRRPPEEIVLTGGPYDLRRTVVSVRINPASPYRVKPDADGRLMLFLDGRAIAEVGLPPMPDYYRHALANGKQVMEVAPTIQWGYLVYLTVFRVCQYFGAKEECQYCDINHNWRQHKAAGRPYTGVKPVDEVLEALAIIDKHDTLKTSQAYTLTGGSVTSKVDGLAEADFYGRYAQAIEERFPGRWIGKVVAQALPRADVQRFHDYGIRIYHPNYEVWDKRLFELYCPGKERYVGREEWHRRILESAEVFGPRNVIPNFVAGVEMAEPFGFTTVDEAIASTAEGLQYFMSRGITPRFTTWCPEPTTPLGRTNPNGAPLEYHIRLLEVYRATMEANGLSSPPGYGPAGAGKAVFSVSSFMDSLPEEA

SEQ ID NO: 14232 - protein, 115 aa, Actinoplanes utahensis
MVRVDDDDFIWSQARRWRAHLDRVNGTGDTELTLRILKITEEAGEAAQAWIGVQGQNPRKGVTHTVDQVVGELADVVMTSLVAIASLGADPRAAVAACAAKAAGHLPAADPPATS

SEQ ID NO: 14233 - protein, 322 aa, Actinoplanes utahensis
MDTLTGLLDGARAREAFLLRTVVQPPFALRIQDEAPLTLVTVLRGTTVVIRDEPVRLHPGDVAVIRGPEPYTVADEPDTPWQTIIHPGQVCTTVDGLPRDHLGVRSWGDATEAGTELITGTYQLAGEVSRRLLAALPGMLVQPAAATDRALVGLLTAEMGRTVPGQDLVLDRLLDLLLISVLRAWLAGPAAGAWHPAGHDPIVGPALRLLHDTPAEQWTVAGLAARTGVSRSLLARRFTDLVGEPPMAYLTGWRLSLAADRLRTSDATISAVAREVGYGSAFALSAAFKRERGLSPQEYRRQSPDRHFTAYAPSSTPLLVLA

SEQ ID NO: 14234 - protein, 63 aa, Actinoplanes utahensis
MAVEVPLNDRLAAASLSDPAAARRNFEGVWVPVNDVRTLLTASALACLAPALGLARRPARMSG

SEQ ID NO: 14235 - protein, 72 aa, Actinoplanes utahensis
MKPRLTTGVLVAALICVGLMAGIFFAFTTSVMPGLHTADDRTFVEAMRHLNAAIENGLFGLVFVGALGFPAG

SEQ ID NO: 14236 - protein, 284 aa, Actinoplanes utahensis
MAPARRGGWTRGMTEMTTVLVTGGTGKTGRRVVRLLRERGVPVRVGSRTGSPAFDWAVPATWAQALDGTGAVYLCYQPDLAFPGAVDTVGAFVEQAVKQGVRRIVLLSGRGEPACAAAERVVRDSGVAWTVVRASFFAQNFSEAFFQPAVVAGEIVLPVGDAPEPFVDADDIAEVATVALTEGGHDGRTYEVTGPRLLSFAEVAAELTAATGREIRFTPVTREDYLEALRAEGLPEEFADLFQMVTDGRNAYLAYGVRHALGREPRDFRDYARAAAATGVWSAA

SEQ ID NO: 14237 - protein, 302 aa, Actinoplanes utahensis
MLAALDRLPGRIGQRRGNGVRPSARAVAATASDGAEKSAANPETRRNDRCRTIPAELYGGWTIVKIFAVLAVGAVLLGGCAHAVKPAPVVSSAPADNGVAALPAEQIVQRAQAALKAAPSFRVRGSLYPDGSRFGRDAGKGRLWQLDMRLSGTDRAGWTAQGQSRQDELVVGGKRYLRSSLEILAQQMRRADAEKLLAGLGGHWVTLRPDEDVYGDFVTRTFLDGLLTGGTTLTKGTTQVLNGVPAIAVQSGGTTLYVATTGAAYPLKLSWKFQALSFSEFGATFPEIQAPPPADVIVLPDN

SEQ ID NO: 14238 - protein, 39 aa, Actinoplanes utahensis
MVRHRSLRRVSGFAADFSAPSDAVAATARADGLTPFPRR

SEQ ID NO: 14239 - protein, 472 aa, Actinoplanes utahensis
MTSENRWRAMSVALVAGFMTLLDVSIVNVALPSIRAEEHLGSGELQWVLSGYALTFGLLLVPAGRYGDARGRRTAFIAGLAVFTLASAAAGLATGALWLIVARLVQGAAAGVVNPQVSGLIQQLFEPHERGKPFGLLGATIGISTAVGPLLGGLLIQLFGAEQGWRWIFYINVPIGLLAIVLGARWIPARPPEQREHESLDPVGVLLLGAGVFLLLLPLVQEREWTGNAKWLLVVAATAVLAGFWVWERRFARRSTPVVDLGLFRTRSYALGALVGILYFGGFTSIFFTYTLFLQNGLHYSALQAGLAITPFALGSAATAALGGRAVDRTGRTLVVAGLAVVAAGLAGTVLVLHVVDGTAAGWASVVPLLVAGLGSGLVISPNQTLTLSEVPVRRAGSAAAVLQTGQRIGAAIGIAGVGSVFFNRLAGHNGDWGLAFRTSLTVTIAFILAALLAAGADVLAGRRREHTMTLR

SEQ ID NO: 14240 - protein, 268 aa, Actinoplanes utahensis
MSELPTGAYASGQHSDQNSSKAAQVAAEGKQAAGQAVSEVKDTAAEQVRRVGQEAGAQARNVAGEVRDKLGEHARAQNDKLVSGIRETADHLDEMRGDRSGTPAAAVVSRVAEGGRQLADYLDRNGPEGVLAEVQDFARRRPGAFLATALAAGFVVGRLGKSVAKADEATGGKPAGDAYSSVTPSTAPTSSFATTTSTDYASATGAGADYVGTGNEYASTTGAGADYVGTGTGYAATTGAGADYLSTGTGTPIPVQEEYPIGTREPRP

SEQ ID NO: 14241 - protein, 135 aa, Actinoplanes utahensis
MTAPEKSDQVAQTSIGELIGNISDDLSQLFRQEVELAKAEIKQEATKAGKAAGMLGGAGFAGYLAVLMLSLAAVFGLDAVMPAGWAALIVAAVWGIVAAVLYVTGKNRLKTVDPMPRRTVETIKEDAQWLKNPTG

SEQ ID NO: 14242 - protein, 219 aa, Actinoplanes utahensis
MAEEPDRLRQDIERTRASLTRDVDLLAEKTSPSKVAKRRWSAVKEKVMGSADYTRQAVGESTSTVQDKASHLADVAGEKASHLTDVAGEKASHLGDVAGEQAHRAADAVRAAPQAVARQTAGSPLAAGVIAFGLGLLAGGLIPVTEVEKRAGRQLKENSGDLTDRVKDMASEVKDELTGTVQQAAQEVKGTAQEAVQTTKEQAQDSAHRATEQTRHAVS

SEQ ID NO: 14243 - protein, 81 aa, Actinoplanes utahensis
MLTQVKDPGTAGFAAVAGVLVAFWSASGYVAAFMRASNSVHDVPEGRPICRHHPKHREVAGAAGAGQPDVRAAVRPHAQKA

SEQ ID NO: 14244 - protein, 147 aa, Actinoplanes utahensis
MNHDDLLIRIQRSGRLHGRNESRRIAVTVLGVLSEVLPAAAYRRLTATLPEELRQRLPPAEPGRIVEIVDCRRFLARVAARLYADGGDAAFLTRVVLAELNDGARGVSPAELAHLVPMDLRALFRSRPLLPWTGAAIEPDVAYQRVL

SEQ ID NO: 14245 - protein, 718 aa, Actinoplanes utahensis
MSIHYRSGRTRADPTVSAMARIHHRPWAAAALTLAMTAGGLAVAGPAVADILDPAACLAAATGSLAFDSTVQWGESTKLSWTTNLAATKVCDGGTPQIRLFEGNRRQIGPVLSATGSMTVTPTEHKAWTLELSIGTSSTKTLASVFPTVVPYPAEPLPAGTAVTISSNDLAERREFLRAIRTPGATIQIPGDVVLDLSGLDHVQVAPGVKVLGDRSVNPRGPRVFTTTYPDSLLWIGVYGAPSDNVRISGVRFDGLEPADPMASADTPDATAISIFSSQHIEIDHSEFARWRGFGVAVYDHDQRINLDNADTVWIHDNSIHDNQHPAGDDGHGAGYGIVLYESAYALIERNAFDLNRHSIAADGHPGTGYLAYRNLFERPGYAATNGKHGWPIDMHGTGCGQDGSVYNCGPAGAYVDLRYNTVTTTGAPAVYLRGTPSITFDVWNNVFAESADDTLKQNETGLNNKGGNVFSSPLVGDRKYCDFDGDGKLDPLLASGIGWWYQSSAADRWVFVNQSWLRLTEITLGDVNADGFCDIQAGGKTYYSPHTPDPMPVEALETQDQETLPNIPTTTNLKAVGGQAPYTWSVTGLPSGITATSTGVLSGVANGPATTVVYTVTDALGQTSTQSFTWLPAVTHVPALLGLDEYTAYLWIDSSYLNAVRKYTNDCLSPGDVVKQSPQAGRKVQASTEVTIWVSTCVSGGGGGGPNPNPKPPTWPK

SEQ ID NO: 14246 - protein, 768 aa, Actinoplanes utahensis
MDTHLFVGTTYAASEGRLRRGPGVGRVARRRSRMYTWNDDGRWPLVGREDELHAFAGLLSGARRQGFVISGPMGVGKSRLAVECLTRAGAAGFRTARVNCSEAAGTVPLGAVVHLLPPDLDLADPVAAFRRAAEVFAVGRDEPGWLLLIDDLHLLDRASAVLLRQLVDAGSIRFVATVRAGAPQTAAADALCRTDAVLRVDLGPLRRDDVADLLRRVLGGPVAQQTVREFGTASAGNALYLHELVVDALRRAAFRWDGLVWEADAPAGTTRLREMVRPLLAAAGRDLIELVALCEPVPLAEAERVATPGELAGMEAAGLLRADRDGPHTTVSFAHPMYGEVARADVPLLRRRTVLLEQAERVEGYGLRTVSFRLAATGTADPELLRRAATVARHAHDYPHTITLLRAIPQGVRTVADVLLLADALLHLGRGATAERELAAAAGHHALAESDRVQLTIARTRNLYWQDTSPARALAINRRARAAVKSATLHHVLDLNEGCLRFVQGEMTEAVRLLDRLEPEVDDAADVTVWFLAAGLKPDALAAAGRTAEAIEWARRAYRANRRHAVRGLLPHAASHLTSLGAAQAEAGDLAVARETLTAAFAELLDAGAARPQVWAAMNLGRTELIAGRLTAARHWYSEAATLTRALGYRRAHAIATAGLAAAAAQQGEPRPDGMPADGTVDTDHEVGRAWTLAAAGHLTEARELLGGAVGVARAGGRVTEELYLLTEISRLGGAKPVAHRVAELARECDGRLAAARAAFVAALAGDD

SEQ ID NO: 14247 - protein, 60 aa, Actinoplanes utahensis
MVPLTGREREVALRAAAGASSRDIARSLTLSVRTVDNHLNRAYAKLGVTGRRDLPGALAG

SEQ ID NO: 14248 - protein, 176 aa, Actinoplanes utahensis
MTISQTPATFTTNQDLDPIRLRRAFGVFPSGVVAVAAAVDGRLVGLAASSFTSVSLDPPLVSFSIANTSKTWPDLRRADHLGVTVLAAHHGAICRQLAGAVEHRFDGIPVSVSDEGSVTIDDGLARFDTTVYREVEAGDHTIVLLRLHAVDHPADQGDPLSPLVFHRSVFGRVADV

SEQ ID NO: 14249 - protein, 746 aa, Actinoplanes utahensis
MRDGVTPTHHRRRRRRPGGVSRRAGHRAVRTRHHAGHRVSQRHRVPDPDAPAEGRLARRALGGDRPGRRRPPGPPLVSTHPGRTDHGPHRTRRPPPAQRDRPGRADEADMGLLNTLIAAFLRSAARRWPADIRDEMARDWIAELGALQQRPGTAWRRLTFAISLAATPLAIDESGAPRGRWEWMRAGVTLRTVVRLMLVAGFGLGGASAVRLFAGDLFLDDLADDADWLVFQLTVGLVTTLLITGYAVTAARWAGSRGAPEPGPSGSLGVAATAVLPIAWMVPFFLAVHADTVFTICLGITATWAALTIGLVVATVRALSAGRRGRAWLVAGLGVPLTPMLSAAPLLLADIAGYNIYLIQALLDVALFLLPWTICAVTFGRAAVRRWSTTGPATDAVPAPEQAAVQLGWWQPTAERLLLLALTVTAATGWALGMTVLQPMSEPTGPDAYGENNTYWARELRWGALIALVVIILVYVRGDRRATRSVLLGGVAWLAADIALDRINPTTVLLPVAAALTALLCCAAAGGLPLVPQPRTLFGAALVAAIAAGLATDTESPTDVERGLNLGSAAAGSLLAVVAIVAAARVAATVSRRRIAAAIPAGLVAAATPWVLRLIYPHPTDARNYGTLAFTVLLGSAVVALAAPRPRTHRDWLRYPATVLITTVSVPLMLFPLVIASIALPYGALFTALAGNPEINSADTDNVAVILAVPIGIVLGRMLRGFAFGRPRATVRRTTEPPPKAHPSPA

SEQ ID NO: 14250 - protein, 157 aa, Actinoplanes utahensis
MPSAQVAQLLAEHRVAVAVLNACQSAMQTGSEASLAQDLVAAGAPVAMGMAYSVTVSAARQAMPILYGRLAAGDDPVLAAWQARRCLHDDKSRRGYFEQHLDLEDWVLPVVFAQRDSSLSRRPMTAAEQESFYRRREQVGRRPGLPPGTGGVARVPG

SEQ ID NO: 14251 - protein, 61 aa, Actinoplanes utahensis
MEWRESRGSWPSDVDEIRSRIAKVPVGTLGHLVAEIVPAGLGDEWERMFGAGAAVVDPGTD

SEQ ID NO: 14252 - protein, 187 aa, Actinoplanes utahensis
MTDTSQRDVIDILTADHRDVTALIGEIKQVADPMIRRDLIDTAISELVRHAVAEEMYVYPAMKKHLPDGEKSVEHDVEEHKELEQTMKRLEDVDVSSAEFDAVLLELETILADHVQDEETDQFPLLRLHIPREELIELGTKVETAKKVAPTRPHPGAPNNELFHKLVGPGVGLVDRLRDKLTGRATK

SEQ ID NO: 14253 - protein, 121 aa, Actinoplanes utahensis
MRRLLFLLASATLGAGLLILLSAGTGAGRPFGIAFCALLTVGGAVGARRGRGPVARGVRSPQLAANFGCALGLCVLATLLWWWRPSVGTGMPIGAFLGCSAVSAVLMIVVGLTGRRAETGE

SEQ ID NO: 14254 - protein, 66 aa, Actinoplanes utahensis
MIFNLIRRFVITLIAVPLAAAGARKLGNTLEARRGPNKTSRLLRQGADTLQGFGRQKKRSRFSFSR

SEQ ID NO: 14255 - protein, 135 aa, Actinoplanes utahensis
MTDGLGPMGDLHLIAAALRADRADVESYTRVLTAVLGDALPAGMVEVERKRSLADRMGGRPGTPVSLTVTTPDEQLVLRQAAHGVHAEVCRIVRGVTIKRSTVDVDDWLVALAGVLSKLAAGSAAARETLDRLLG

SEQ ID NO: 14256 - protein, 274 aa, Actinoplanes utahensis
MTVPTPGVPDDAMRRLAQMRPGQPTSLFTSDLSVNEFLLVREAGFRPLGLVLGSSIYHVGIQFGRWSQNRELDQLSQAMYHARELAMTRMEAEADALGADGIVGVRLDIEFKEFGSELAEFIAIGTAVKADAPPDSGGGWRNRHDQPFTSDLSGQDFWTLIQAGYAPLGMTMGTCVYHIAHQRFWQAVGNIGQNVEIPQYTEALYDARELAMSRMQAEAEQLGAEGIVGVQMLSNSHRWGGHTTEFFAIGTAVRPLRADHVIAKPQLVLPLTDR

SEQ ID NO: 14257 - protein, 298 aa, Actinoplanes utahensis
MSVDGWDGRGLPPVARARIARAANGGVRTSLLSADGVAGLEVAGFDTVGEVLGTTVMQIGWTGWGGCGWRPGVNPGLIAGLLGDPGPAAGRPSGAGFAPYTRAIRHGRDTALDRMRQEAAALGADGVVGVRLTETRMDDQKREFMALGTAVRARGRQRAGVPFTTDLAAQDVAKLLGAGWVPAGIVYGLSVAIRHDDWRTTSSLSFFAGNVEVAGYTELISHVRAVARDEFARRVAATGADAALMSGLSSRMWAIEVADNHTDHAAECIVTGNAIAQFRTGQLSTPNSLTILPLRSPR

SEQ ID NO: 14258 - protein, 286 aa, Actinoplanes utahensis
MLTTVDYLAADSVDEVLAALADGRTSVLAGGQSLVPLVTRPGAPRSRLVDINRVAGLDTLTEVDGFLHVGALVRHRAFESDAVGGALGQLLRVVVRHIGHPPIRARGTMLGSLAYAHPAAEWPAVAVTVGARLVLDGPAGRRTVPAGDFFTGPFQTIRRPEEMLIEAELPVLPGGTGIGYAEDRRSTTFPHAAVLAAITVTAGAISSAAICLVNSGPCPVRATAAATALLGSTFSDAAIAAAARTAAQDDTRLLAGDARRPGRRQAFEVLTRRALRQARQGAGRCG

SEQ ID NO: 14259 - protein, 79 aa, Actinoplanes utahensis
MRVRLTVDGVPHDLDVEPRRTLAGVLGMPVCPDGACGDCDLAVDGVEIRSCLMLAVQAGGARVVTDVGRRRAPGPRRTA

SEQ ID NO: 14260 - protein, 505 aa, Actinoplanes utahensis
MVRRTLVSMLLAVASSVAGVAPPAAASPPTPGNAYATIVPAPVSAQAGRGAFRIDRHTTITAAGPGAAGVADYLGELLGLPVVRSVRAGAIVLTVGGGGAPESYRLGVDRRGVRIAAPDAHGLFNGVQTLRQLLPTRGPLSVPAGRVADRPRFGQRGAMLDVARHFFTVEQVERYLDQLAAYKVNTFHFHLTDDQGWRIEIRSWPRLATYGGSTAVDGDPGGYYTQAQYREIVAYAQRRFITVVPEIDMPGHVNAALASYAELNCDGVAPPLYTGTDVGFSSLCVGKEITYRFLDDVIGELAAITPGRYLHIGGDEADSTPAADYATFMRRAQAIVARHGKAASAWHQIVAAGPRPSTVAQYWDTTPDNPAVAAAANAGTGIVLSPANLAYLDMKYTPQTPLGQDWAGLIEVRDAYGWDPGAYLTGVPAAAVRGVEAPLWTETLRTSNDLEYMAFPRLPAIAELGWSPAATHDWDVFRLRLAAQAPRWRAAGLNFYPSPQVPWVA

SEQ ID NO: 14261 - protein, 31 aa, Actinoplanes utahensis
MAGAASAPAGKEETGDHKDNMASQLSPEAAG

SEQ ID NO: 14262 - protein, 90 aa, Actinoplanes utahensis
MPMTSVVVLMTELEDATIRRVAAEAGVPARQLQYYFGTRDDLLLGALELLNRDGRSVTYPGAGRRWVTAVGSAAGPYERAQLPMSGHLAS

SEQ ID NO: 14263 - protein, 466 aa, Actinoplanes utahensis
MNRRTLRRLVAPLSAALLAGAWLVAVIQPASAADTLLSQGRPALASSVENGESPAIAAVDGRSDTRWGSQWADPQWLRVDLGAAATITQVTLQWEAAYAKSFQIQTSPDGTAWTTIYSTTTGAGGTQTLSVTGTGRYVRMYGTQRGTGYGYSLYEFRVYGTSTVTPPATDGPGYIMANPPVTGVIPSTATPPAQNPPVTHHEFQANCSVSRTNLTDDPIVFPGLPGASHSHTFLGNRTTNATTTLASLQAGGTSCITPGDKTGYWMPTLLNGDTAVQPDGPQVIYYKSGVLDYTSVRPFPAGLRYVVGSPNATIDEFRNNPGAVEGFECGDSTRNWDIPANCVAGSQLNVRLQAPSCWDGIHLDTPDHKSHMAYPIVGVCPADHPVAVPMIEFKMAWPVSGTMANVHFASGRGYSFHYDVFNAWDGPTLAALTTHCINGGLQCNPRGFDQYKPDRGAALNENYELP

SEQ ID NO: 14264 - protein, 231 aa, Actinoplanes utahensis
MLRTGACSGIEQGKRSPSESDCFSRVAGRQYSALTSRFRNWKLRDVRTRRRLGALAAACGLAAVTACGSPTATTPPAGPPPGTPAASFGGTDIAWIQINIAMDEQLLPLLALTPSNGADTGLRAVSDQVRALSERELGTLRKLHDEAGLSGGNPHEGMPMPGMVTPAMLAAATGQHGAAFDRTLGVALREYLEQSRQLAGSEQSAGAETRTRALAASILQSRAAALGALKK

SEQ ID NO: 14265 - protein, 1144 aa, Actinoplanes utahensis
MSQISASGPRRRRPSLVAAVVALLLGLAAVAVATAANAADTLLSQGRPATASSQEGADVGPGNAFDGNAGTRWSSRFTDPQWIQVDLGAAATISKVELRWEGAYGKAYRIQTSSDGTAWTDIYATTSGAGGTESLTVSGSGRYVRLYGTARASGYGYSLYEFQVYGSLSTGTPGADCTTNAAQGQPAAASSVEGADVSADKAVDGNTGTRWSSQFSDPQWIRVDLGATKTLCGVVLQWEGAYGKAYKIQTSPDGTTWTDIFSTGNGAGGTEALTVSGSGRYVRLYGTTRASGYGYSLWEFKVLTGGGTTTPSTPPTQDPTNYTTVWQDDFDGTSGTTPSAADWLLRTGTAYPGGAAAWGTGEVETASASTANVSLDGSGHLAIRALRDASGNWTSGRLETRRTDFEPLAGQLTRFTAVLRQPDVANGLGYWPGFRATGAAYRGNYTNWPGVGETDIMTDVNGRSQLSQTLHCGTAPDGPCAEYNGRNSGFASCAGCQTGYHEYSQVVDRTRTDEEIRFYLDGRQSWVVRESQVGVAAWNAAVHHGFFLRLDLAIGGSLPNAIAGRTTPTADTTPGGVLSVDSVTVSRATGTTPTAMTDPAIPAGPSVVKVTGSQGNWKLTVDGQPYQIKGLTYGPPARAADGYLRDLKNMGVNTIRIWGVDDTDTPILLNAAARQGIHVIVGEWLNQGADYVNDTAYMNSVKTSIVNQVNALKGNPGTLMWDVGNEVILTMQDHGLSAADVEARRVGYAKFVDQLADAIHAADPNHPVTSTDAYTGAWPYYRQYAPHLDLLAVNSYGAIGNVYDDWVAGGYTKPYVVTEGGPAGEWEVPGDANGVPTEPSDLQKRDGYTASWNAITAHPGVALGATEFHYGLENDFGGVWLNTFTGGWRRLGYGALAKAYTGRALANTAPEITAMTVSNPAAVPAGGTYTITTSTTDPNGDLIRYNLMYSDKYISGGTGLTNVSFTDNGNGSFTVKAPETLGVWKVYVYAFDGQGNVGIETRSIRVVPPTVTGTNLAKGRPATASGYQPTGINGPQLPSYAVDGDYGTRWASEWVDTAWLQVDLGSVQSFDHVNLAWEAAYATAYQIQTSNDGTTWTTAYATTTGDGGFDNLAINGSGRYVRITNTARATAYGYSLYEFGVYRQ

SEQ ID NO: 14266 - protein, 158 aa, Actinoplanes utahensis
MPACGTHSAVHTVELLLDAGREDDVRRQWELLRDAGLPSLADHRHPTNRPHLTLVNAASLAGLPDLDLPVAAALGPVRMLGRALVWAVTPTEELRELHFRVWSALPQAWPPPDRWIPHVSLALRFPAAAAATITPADVRGEFVAARSYDTATRSVTGL

SEQ ID NO: 14267 - protein, 157 aa, Actinoplanes utahensis
MAAARQPVSHCRGGRSPGRVVESAAIGDREGMSLLRTLGQVGLGAVLLTAGAGHLTTKRQEFQAQVPSWFPVDPDRVVVVSGVAELALGTALLVTWRQPARRRLGNVAAAFFAGVFPGNIAQFVERKDSFGLDTDRKRAVRLLGQPALIAWARASTR

SEQ ID NO: 14268 - protein, 243 aa, Actinoplanes utahensis
MAGVRVGLCGASMALASYAQRFPVLEVQQTFYEPPRESTLRRWRDTVPGEFEFVVKAWQLITHEARSATYRRLRTPLSEAERAEVGGFRWTPVVARAWDTTVRCASLLRAGAILLQCPASFRPTEPAVTRLREFLARAPRPDGVRLLWEPRGPWPDDLVRDICAAGDLTHAADPFLRPSLTPTAYYRLHGVTGARHVHTDDELARLAAMVDGGPAYVMFNNLARADDARRFRRLVAGDAQHTG

SEQ ID NO: 14269 - protein, 202 aa, Actinoplanes utahensis
MATSGQRRGADTKAEIRRVAIELFTERGYEATSLREIAERLDITKAALYYHFSSKESIVLSIFQAHLDALDELVDWAREQPPGPELRAQVVDRMVELGVGSGMAAMKFAMANQHVVRDLHQQQGRENAFGKMTELFDIVTGPDATVEETLRVRSALLSVNIVLMASRGLPVTDTELAAVARNIAHSLIAPGPDRPGAVRDDD

SEQ ID NO: 14270 - protein, 510 aa, Actinoplanes utahensis
MTPPTRFTHREIMVTMSGLVIAMLLAMLDNMIVAPALPTIVGELHGLNHLAWVTTGYILASTVATPIWGKLGDLLGRRITFLSSIAIFLLGSALCGMSQNMGELVGFRALQGLGAGGLMVGVMAVLADIIPPRERGKYQGVMMAVMPVAMIGGPLVGGFITDHLNWRWAFYVNLPLGVVALGVCWFVLAKLPRGAGAVRIDWLGAALLSVWITALVLITTWGGSQYAWASAQILGLLALAVVAFVAFVVVERRSAEPIMPLSVFANRNFALAGALSLIVGFAMFGGITLLPQFQQYVQGSSATNSGLLLMPMMLSAMVVSLVGGQLITRTGHYRALPILGTVLMTAGLALFATMDIGTSRFTTGLFMAVLGAGMGCLMQTTMLIAQNSAPIQAIGAATGAATFLRNMGGSLGVSLLSTLYTNHLIHALGGGVPTGSAAGMTPAMLRALPDNVRHLFAQAVTDGIGAAFTWGAVAAAAGIVVALFIRHVPLRGFADAPKAPEQAAEELQAV

SEQ ID NO: 14271 - protein, 352 aa, Actinoplanes utahensis
MSELLDIRRIYVEPAAAELPRGKEILARFPGAQLVEVESHHRIPELYGDETNVNRWVRIKREALVLGVKKTLAARPNGRSADFIAPSTANGCAMACAYCYVPRHKGYSNPITVFANIDKITGYVARHAKRQGVKSAPNECDPVAWVYDIGENSDCSVDARISDNVRDLVELFRWLPTAKASFATKHVNRDLLGWDPQGRTRIRFSLMPAKDAKVLDIRTSPVAERIAAIDDFVAAGYEVHVNFSPVVVRDGWLQDWAELLDQLDAGIGDAAKRQLAAEVIFLTHNRELHEVNLGWHPKAEELIWRPELQQPKRSQNGSWNVRYRTGEKGRYVAELVDLIGARTPYCRVRYAF

SEQ ID NO: 14272 - protein, 332 aa, Actinoplanes utahensis
MTGKPRRAYGFEVTRRLVLLIIGAAAVVLVPWSVYLADTLPDRYATGQWRATWVGFDLALAACLAISLRLGLRRRPAAVPVLSATAALLFCDAWFDISLDWASSDLAVSVVLALLVEVPFGILLLVWARRLISGGMRHTQLTMRHLRAREDPEFDRTMVALDRLGPADCRTIAAAVGVSEAQVGLQLREAEQLNLVDRRRDGRWLLPAHQNLRLPSLEAARDGEDRERLLRFLDAKYRSELELLAWAVEHHAEFGRWGHGERAVTHLSGPELAAFIREYQELSNRYCLLRSAPGPDTREVAIRWYAFPKPADQPALVSVPHTSGATPLSLSR

SEQ ID NO: 14273 - protein, 191 aa, Actinoplanes utahensis
MWRRRRFRDHVGVPALIAPTGRVRQSFLAAMAEFRAEGRAGPGDQSMIGREWREFGDRWPTPEGFAAYVDRLLSEPVEDTPRPEGFVPSTTLWWVDGDEYLGRLAIRHRLTPQLLDFGGHIGYDVRPSARRRGHATAMLRAALPLARALGISSALVTCDVTNVGSRRVIEANGGVFEDQRAEKLRFWVPTT

SEQ ID NO: 14274 - protein, 497 aa, Actinoplanes utahensis
MPVPASSLAYCRVTAFRNDFDGEYAALIGPVSAPGVDCRVSEPTLLDTFTIRGAGDRRSSGSIALVTRTTPITLVSTTVRITAGSTTVGSCGRPPVTPALLTSTSRRPNRRSTSSAAATTLPSSVTSSGTPTASTPAARSFATASSRRPASRAPTATVCPSSPRPAAISYPIPLFAPVTSATLVSLMTRSCPRRRPGPNTDRVAGSYPVVMETRELRYFVAVAEELHFGRAAQRLGIAQPPLSRAISRLERRLGVTLLDRDHRGAALTEAGAVLLREARVALDAVEAAERRTRRAAAGRPGLVLVTKAGATTELLAKLLDAYAAEPGAVPVEVALCGIAEQERVLRAGRADVALLHLPFDSTAGLDTEELGTENQIAVLPAGHPLTTRPHLRMAELRNLPGLPLPRWPRPDGTYPDGPGPEIRDHAQLLQLVALGRLCTVLPESARPHLREGLATIPVLDAPPVTTVIAWPPHSRSRPLATLIHTATRLHQATITGP

SEQ ID NO: 14275 - protein, 216 aa, Actinoplanes utahensis
MVAAVSSTVELPAVGTPMFLVLGEGMNFRSRLEAVDGDRFTVAAPLETAGPVVISAGQQFDVFWAPPSTRIVLPARLVAVSDEAPFRWSLTAAGLPQHSNRREFVRGGGGAAVRLTTDDGEIEGALLDISEGGLRCWIDEPAALAAGGRMAAAVTLGAAGTIEVSGTILSVREAPYGDPGRHVVLTFDPRESAARAIRRYVMEWEINERRLHRDAA

SEQ ID NO: 14276 - protein, 408 aa, Actinoplanes utahensis
MSHPVQLLGSAVSRWGADPWALGSWSLIGRHGGPRDRVALGTPIGGRVRIAGEATHATRAGMTHGAYEQGLAAAAWAADRGHARVAVVGAGMAGLAAARALTDGGVEVTIWEARDRIGGRTAGVDVAGGAFDLGANWLQQYDENVLARIAEDLGLTMIVTDFNDPLVLRGEPFPDGLEDDLRRRLASAAPDAGIADVLDAWLRDPAPWTAAEIHRFVAAEIVMDAGAPLSWLSARHGFEPGVGEGDRWIAGGYRLLVRHLATGIDVRLRHPARHLLTLPDGVVLTGDAGTLRADAAIVTAPVPVLAAGAITFDPPLPEPHRTALSRLGAGRVEKVILRFDRRFWPEHGYYRVHGPSELCISEWLDASAADGVPTLVGLFAGPWLDDLWTGTDREVAARAAEVFRAAVG

SEQ ID NO: 14277 - protein, 140 aa, Actinoplanes utahensis
MTSTRWTAGCLTVAAVLGLLAAGVFLVDDHQRGRIVDQGHQVRAVVTADHEDEFDHWYTVDYPVQGTTRSADLRYPWVIDTFPVGSELTVYVDADRPERIATADGYSTPVWASAPGFLAVLAVAAAFASTAGFVSNRRSS

SEQ ID NO: 14278 - protein, 400 aa, Actinoplanes utahensis
MVFEVAAFREHFPALRHGLAFFDGPGGTQTPAVVAEAIAATMTAPLSIRGTVGIPDGNAERAVREFRAAYADLLHVPPAGIVHGRSATQLTYDFSRHLAKTWRAGDEIVLSRLEHDSNVRPWIQAADRAGVTVRWIELDPAAATLDLDSYRRALSPRTRLVAVAGASNVLGAKPPLRHLADLAHTVGALVYVDGVHLVPHDLVDVPALGADFFVCSPYKFFGPHCGVLAAQPALLETLRPDKILPSSDEVPERFEFGSLPYEMLAGATAAVDFIAAIAPGPGSSRRERLAHSMAAVHEHELALRARLEAGLAALGDAVTVHSTAADRTPTTLMTLTGRDARAAQVHLAAVGVLAPAGSFYAYEPFTALKITDPALRVGLAPYNTAAEVDRFLTALTDFLS

SEQ ID NO: 14279 - protein, 652 aa, Actinoplanes utahensis
MHSIRTRLVTSVLVTVLIAVASLVTIAVVMTRSLALRQAGDYTEQLAMRQSAAVSRVIDVAVHATEELAGTLARLKESGVTDRRVVTDLVGAALRRHPDFFGMSTGWEPNAFDGRDRDFRKVAPSDATGRLIPYWYRDGDRLRTDPLVDYDKPGAGDWYLQPKANSKSLVVDPYVYQVNGKDVLMTTATAPILSGGRFLGVVTADLALADLRTAVTAEKPYGTGYQALLTAGGAVVAHPLADLLGKPLSEVSAQVGAAVSGQRPVRWSGQDPYLKSAATAVVAPVPLATGDSWALLVAVPHSTITAAADDMRRNLLLAAGLAFLAAGAVAWAIGTGLARPIHRLRDRLVEIAAGDSDLTQRVDQDRRDEIGELGAAFNRFTAKIADVVRRIGEKAEGVSAAADALTGVSERMRGTADDSAGRAAQVSDTADQVSGNIQTIAAGSEEMNAAIREISASTMEAAQVSLRAAEAAQASTASVTKLGESSTEIGQVVRLITAIAEQTNLLALNATIEAARAGETGKGFAVVAGEVKQLAQDTGRATGDITSRVETIQSDALAAADAIREIAEVVDRIHELQSTIASAVEQQTATTHEMTRNVAEAAGGSAAIAGTIGAVADAVHETNVGSQATGRAAQELAELAGELRSLVGQFRV

SEQ ID NO: 14280 - protein, 209 aa, Actinoplanes utahensis
MVVSETGLRQRKKQRTFDTVSEIAIGMFLEHGFDRVSVTDIAAAAEISKPTLFRYFASKEDLVLHRFADHAGEPARTVSSRPAGRSPLDALHRRFLDGLATRDPVTGLNDVPQVLAFHDLVFSTPSLATRVYDYQLRDERSLAESLATATPDPLTARLAAAQILAVQRVLARENWRRLTAGATADDLYPAAVEAANRAFDQLRSGLPLR

SEQ ID NO: 14281 - protein, 20 aa, Actinoplanes utahensis
MVLTRAVSRMDVLHTGDLPV

SEQ ID NO: 14282 - protein, 188 aa, Actinoplanes utahensis
MRLTYALVPILIMSLAACGDKKVAAPAATPVTTTTTTTATAESGVAPASAKPVAAPKSPAVVKAKPAGSSNPAFGIQYALLKSSKPATRQITYDLIEWYEGKEATKACAEDGVKDTDDDQCTGWYIRNNNTKLRTLTVDPDATIKLTVEGTLKSVDLKTFLAGTHPDTVIKFTIDANRIVSLAEIFLP

SEQ ID NO: 14283 - protein, 383 aa, Actinoplanes utahensis
MWRYHPALDGLRALAVTAVLLFHAGVPGVGGGFLGVDAFFVLSGFLITSLLLDEHRRTGRIDLGRFWRHRVRRLLPALLAMLAATVVAGRYLLDPDALGLLRTDAWAALGYAANWRMIFRGTGYVAVTATPSPLQHTWSLAIEEQFYLLWPLLVAGVLVGLATRTARRLLLAGCAAGIIVSALLCAALFQPAAPGRAYFGTDTRAQALLIGAASAVLLARSGRARYVGGPVPVLAGVAATAGLWHLASEQARWMYHGGLTAAALAAALVVTGVVGDPGSGPARLLALPPLVWLGRISYGVYLWHWPLFTFATTETTGLSRWPLLAVRLAGALALAVVSYHLIELPVRRGLLARTLPRHGPAAVTAAAAAAVLLTIGLSTLLAS

SEQ ID NO: 14284 - protein, 262 aa, Actinoplanes utahensis
MIPPIPAAPAHRTTGRLPAPTREPRVTFLGDSVSWTIGTYLPPHPGMWTSVRAIQGCGIATLPDILQQGTPHTNYPGCTEWPRRWRQAVIKDSPDVSVILLNRWELMDRRYQGGYQHVGQPGYDGYLTDRLDLAIQAAATRGAAVALLTAAYTHRAERSDGSLYGEDRPDRVDAWNSLLRRVAARHPGRVTVLDLNAVVCPDGRYTATVHGLRVRSDGLHFTPAGVQQVIAPWLLPRLAALAVGGDRGPAGLPGSRPGRQRS

SEQ ID NO: 14285 - protein, 67 aa, Actinoplanes utahensis
MSTEQQAAGRHPTDEPDGTPAYAASLRRPGESVAGAPAEEPEPDEAPTGAGYDENAVSGDSTAYRPD

SEQ ID NO: 14286 - protein, 57 aa, Actinoplanes utahensis
MNDVDPEQYDEDTPGQERVPKRDAQEAHGGSMAPGLVDDTGHRTAEPLPGAPVEEPR

SEQ ID NO: 14287 - protein, 77 aa, Actinoplanes utahensis
MSNAPDRNDPDRARGLISDAQGEFVQEHPGGAFDPRAFRSGHPAPPAEPPAASHPAGEPPMRGNRMAPPGEESAKAE

SEQ ID NO: 14288 - protein, 34 aa, Actinoplanes utahensis
MADVVGGEALTPDPMSRDGDAWAPGLSLTCTRIA

SEQ ID NO: 14289 - protein, 825 aa, Actinoplanes utahensis
MPSAPRRRHSGPCSRCSGPERRTETEADVTTSPPVHPAGSPGGRPLRLKMLIGGVVAVVAVAGSVVVSAGASAAASTLGAAAAQSGRYFGTALAAGRLGDATYTGIAGREFTMVTPENEMKPDATEPQRGQFTFSAGDQIYNWATQHGMKVRGHTLAWHGQQPGWMQSLSGSSLRQAMIDHINGVMAHYKGKLAAWDVVNEAYNEDGSRRQSNLQGTGNDWIEVAFRTARAADPSVKLCYNDYNIENATYAKTLAVLTMVKDFKSRGVPIDCVGLQTHFTGGSALPGNFQTTLTNFANAGVDVALTEADVTNASTSQYAGLTQACVNVPRCLGVTVWGVRDSDSWRSSENPLLFDGSGTKKAAYTSVLDALNAAGPTPSGSSTPPSGTGEIRGTQSGRCIDVPNRSQTDGTRVTLYDCNRGTNQQWTYTSNRQLTVYGTKCLDAAGSGNSAAIQIYSCNGQANQQWNVNANGTITGVQSGRCLDVWGTANGQQVQLYDCNGQANQQFTYSAPGTSSPTPSPSGSTCTLPSSYRWSSTGALAQPKNGWTSLKDFTNVVYNGKHLVYASNVSNGSYGSMNFTPFTNWSDMASAGQNGMSQGTVAPTLFYFAPKNIWVLAYQWGPTSFSYKTSTDPTNANGWSSAQTLFTGTLPDAPYGVIDQTLIGDDQNMYLFFAGDNGKIYRASMPIGNFPGSFGSSYTTVMSDSTNNLFEAVEVYKVQGQNQYLMIVEAIGSQGRYFRSFTASSLGGSWTPQAASESNPFAGTANSGATWTNDISHGDLVRENPDQTKTVDPCHLQLLYQGKDPNAGGDYNNLPWRPGLLTLQR

SEQ ID NO: 14290 - protein, 330 aa, Actinoplanes utahensis
MPVQTRRMDDLVAGTPALTRLRWLLEGLDGRWPVDVDVDGALDPGFAAGIGGASALRDITGSRAAGLAPIRVVGVDADGTAATARFRTRDDDLWVSHVEVGAEVPHRITLTHTQRWVPDYLTPGLPADFTGVPMTSRSGAALIVFGGVPGSGKSTVADRVGAALDVPVFALDWLMGALSPFGMRHRTDLMSIGAELLTTLAYRELSAGRSAILDTTSEEPGVRARWASLASAAGAAFIPVVCACSVESLHRERVETRVRGIPGWADAGDWPDAKARLAAFPPWPDALLVDTARPLEACVATVLGHIDHRRDADASRGRAGSVSTFRDKRI

SEQ ID NO: 14291 - protein, 180 aa, Actinoplanes utahensis
MLVGVVGVAATVFFGIQAHGDSTGGSTHAGPSATPPSKPSPEHVIYVAEVNQWCRDAQAQLDRAGEAPDNGIAAQVRWTTAAENTLKALYSKWAPAPYPEEDEEHIKAMMNSLNRIQVDVNLLLTLLEQQGQAKTQAVSDGLQNQVNATIAKVSDDYNDIDDAIVSYGDLADCRSFFTSR

SEQ ID NO: 14292 - protein, 128 aa, Actinoplanes utahensis
MLLSGWRKPAEQRYNVSFFLKQSVTAAQTSAIRTELEKVPAVKDLRYESKEEALAKFKEMYKDKPEMIEAIEKSGSDNGLPVSFRLDMKASDFDCRTMEAIRALPGVEQYSVVMGSIDENPVLQVRCH

SEQ ID NO: 14293 - protein, 523 aa, Actinoplanes utahensis
MQIGRREEQPLGQRAGQAVAAAQLVPVGADVVPAGATAWARAAADHGVAGDPPAEPALVDAGAGGDDRSGPLVAGAQRIRRGAGVQVAHLAGEQLDVGAAHPDPLDADHHLAGAGLWLRHVLDLGPAGIGEDERAHGRQRRACSRPLPPVGSPFLTCRENGTFPPGPVSREVRGRNPMTRIDSTPFGEAPDGTAIEKWTLTGASGASVSVLTWGATIQSVIVPDRDGRLGEVTLGFADMSGYTDPDNPYFGATIGRYGNRIGGGTFTLDGQAYKLAGNEGANTLHGGLRGFDKRVWAATEVTDGVRMTYTSPDGEEGFPGAVETAVTFSFDDELRLRIDYHATTDQPTVVNLTNHAYWNLAGEGSGTIGDHLLQINAGHYTPVDAALIPTGELAPVEGTPFDFRTFHAIGERLRDDDPQLAYGRGYDHNYVLADRVAAIVRDPATGRQLTIETTEPGVQFYSGNFLDGRLRGISGRQYRQGDAFALETQHYPDSPNQPHFPSTTLRPGETYTSSTTHTFGVFG

SEQ ID NO: 14294 - protein, 367 aa, Actinoplanes utahensis
MRAVIVAAAVAFLVSLFATPVAIRVFTALKAGQPIRSLGLASNEGKKGTPAMGGVAFIVATLVAYVAGHFALTTLPKRQIAQEKPTMTALVLLGVFVFCGVVGFLDDFLKVRRRNSDGLSAKGKLLGQALVGVGFGIAALYVRSTNGQTVASEHISFIRDLDWLDVGKVGSVMVFAFVVTAMSNGVNLTDGLDGLATGASTLVLGAYALIGFWQYRHWCADPTYARPGQYCYQVRDPLEIAMIAAAAACACLGFLWWNTSPARIFMGDVGSLGLGALIGGLAVATRTTLLSILIGGLFVIITVTWVIQIVSYRTTGRRVFRMVPLHHHFELAGWSEVNIVVRFWIVAGVCAAIGLGLFYTDFLAAVG

SEQ ID NO: 14295 - protein, 163 aa, Actinoplanes utahensis
MTALTGGPAGDPDCPRGTILPSAGKRRWEPRLGRVETTPAQRFASARVARLATVTPDGAPHLVPIVFALVGDVIHTGVDGKPKRYRNLRRLVNIAREPRVSVLADGYDEDWSQLWWVRADGVATVSDEPEPALIDRYPQYRVSPPPGPFLRIRVTSWHAWSAT

SEQ ID NO: 14296 - protein, 208 aa, Actinoplanes utahensis
MTAESDRRRAPGMSTEQRREMIVRAALPLVAEHGAAVTTAQIARAAGIGEATVFRVFTDKNELLGACIVAAMDSTTVLGELRSISVDQPLADRLVEAVDALDAYFARMGAVVGAVHASGTPNRRPGTEAVDPTRPAGGTGDREAARAATRQAVLNLFAPDEATLRVPAATATDAFLALFFGRRGAGRHTPVPDLVDLFLHGAVNTGPA

SEQ ID NO: 14297 - protein, 129 aa, Actinoplanes utahensis
MSESSCRICHRAPAAEVTFHGHEGMIVLMRFSRVHGPFCRECGLAAYRDITGRTLLRGWWGLGSFFVTAGVLVLNTVRRARIAALPEADRPANDRTLDPGKPLLDRPAAYGLLVPALLIIYVAFSTARS

SEQ ID NO: 14298 - protein, 308 aa, Actinoplanes utahensis
MVTRPAALVALITVAGLAAPPLGPAMRATWRRLTAGTGLKARAYGLDSVVEEALYLTGPLLAGLLVAAGPARWALLLTAALLLAGTLGMVATPPARDRRPPTGDDPGGHRWLVDTGPLRSPALRGLVVTILAVGTGTSAAYTCLAAFAEDRGAPGAAGLLEAALAVGSVTGGLLWGRREHAGRRHLRHLALLTGVLATGLAVAAAAAGLLMLGLVLCLTGTAVGPVYVVAYLAADDAAPDGSATEAGTWLNVAATAGGAAGAALAGTIAESRGPGPGFLTGAGLLAVTAVVTAVRSRREAVSAPDATG

SEQ ID NO: 14299 - protein, 93 aa, Actinoplanes utahensis
MTVHLFVIVRFVALLAAVPFAWGRGLSRLDLALAVGWCTLTCLGTTAGHHRYFTHGSFKAGRPLRIGLAVAGSLAVQGAVNRPTAARLARITR

SEQ ID NO: 14300 - protein, 1090 aa, Actinoplanes utahensis
MRSGAGGAARAADAAGAPGHPGAAAVPAARPRTHAEHPGGDGATVRLPRRGIPDDLAAAAGRDRPDPAAGHRRPGSARHLGGAARDAADGRARPRPGLVSGGPLRRARRVRDGRGDDFRGDLRALPVRAGRAARRRAAGIPVLRDRHGGPGTAGAGRSGGAAAGRAPGGGGGAERVPVGDAGRRRGQPGAGPGGGRGAGRDRHGVLGHGQRRPTGDAGAVRPARGRRRPGRCGVRGPPALHDVKARRGHFEQDLDLEDWILPVVFAQRESRLDLRPMTAGEQEVFYRRREQVSVAPAVDYGFVGRDLDLHALERLLLIDPERTQVLVRGMAGAGKSTLLAHAGWWWQRTGLIEQVFSFSYEQRAWTAEQITRQIAHELLPAPEFAAWESLGPAARTGLIIDRLRATRHLIVIDNAESITASPAAIPHALPERERDRLARFLSGLRGGRTLVLVGSREAEEWLATSTFAGGVHHLPGLDPQAATALLERIVARHGGSRWLGDTVDDEQRKALSELMRLIDGYPLPMTVIMPQLAGTPPARILAEFGSGGDAVDPSMAARRAIEYSHGKLDPALQESILLLAPFTGSIPVPVLHIYVNELRAGAGEVNIGEVDLAGAVAELRSVGLARAHPELTGFVETVPILPYFLRNRIRGDPDLERVCRHAHYRLYVDCAAFMQDAVLSGDPYRRALGRVMVKAEYANLMASLHYAQGAGEPVLSVVRALNMYLDVEHQHNVRRALLEQAIERLPEPETADDRWELLDLHNIAGNAALTQGQLDDATYHYQLELDMKRALGLREYEAVTLNQLGKIAQEQRRFAEAKQYFQDSIDISLEHNDRKSAATSYHQLGMVAHEEGGLEVAEDYYRQAADLIRESGARQELAAPYHQLGIIFSDKGEWDRANEFFEQSLAIATEFNDRHKMAFTYHQLGMSAFQQGSLDKAVYYYRLALDIEINSGDRIGAASTYHQLGLVAVAQHRVEQAEQYFQQALDTFVDLGELSGCAVVGFQLGDVICLSGRHDVAFVHFIRSIVAYRLSRGIWAVNVLDRLHEEEGHPIDRTLQQAIADLVPVELRGEFGEAFRQRAATPGRGPADRP

SEQ ID NO: 14301 - protein, 319 aa, Actinoplanes utahensis
MEKRATLADVAREARVSRATASRAINGAYGTSPEMREHVRAVARRLGFEPHAAARALATGRGGGGRRERIEILIVDPDPAAMGVKPFYGRVLAGAMTAVDGQDIALEVRRVDVPPAADDDPPFGRLLINISGAAGAAYARRGRTVALGRCAPGVTFVAPDNDGGGFQAAAHLVMSGRKRVGAVFGPATPCARERRAGFLRVMSGAGREVVAADGDFTRARAYAATLELLDRAPDLDAIFAACDVTAMGVLQALRASGRRVPEDVAVVGFDGSALAEAADLTSVFMPAEDEAAAAVRHLLDPARPAPRRLPTTLTVRGSS

SEQ ID NO: 14302 - protein, 914 aa, Actinoplanes utahensis
MRIPRPATVAAVILLTAALTPAPAGAAGPPSCSGAAGYLGTVPSPESFLGFPLGIGQQRVVTNAEIRGYLAAVDKASDRVVSGTMGTSVLGQPLDYAIVSSSRHVSRRSLDRIAGQIRELRDPRKLKAEQARRIAAGEPAIVWIAGNVHGGETSGADASLKTLYELAAGTSCAVRQRDDNLITVILPTQNPDGRDANRRQNEYGFDLNRDWFARTQPETDSKLELLRKYPPQVFVDAHEMGGQRYFFPPDADPIHHEIADAPVDWINRIGAANKAAFGYNGACSDTVTTECYFNYDTYDLFYMGYGDTVPATGFGAAGMTYEKGSASSVQDRVQQQYNTQWATLGWAAANRREVLTGYYRTWSDAVAEGRAGKLEPNQVVQPENQVRFPVPDIRVRSYFLMPGRQLADVRRLVDRLRRMDVEVYEVRKAVTIAHARIFGGRTADEVVVPKGAYWIPMDQPQKHWIQATLGEDPYVPFPYFYDVSSWSNPLLMGIDTVYTGDDVRPRGSLVTGVEGGASGRGRVYTYPLDSASAAQLTFRLLGRGIAAVRDGNLVRVPASAVTPTVDRLARSLGVTLTPSARTGGTALTTPDVGLFRGAGVSTTSGSYGEARYLLGSRWGLNLTPVTSADINDNTPAFTRRSVLLVPDGSNPTGGLTAAGQANLRAWIGAGHTYVGLRNEGTRLARAAGLTSTTEKPQPDDYLVIGSHLRVDVNPASPVGTGRPAADFAFNNGDPILTPSTTGVNVLTYPSDGTFWHNGYTVHEDVLKGTSVVVDEPTGAGRAVLFANDPLFRGYTESGMQLVANALLYPAGNPKPAARTARPEPARAAAAARPAAPNLGGEWRPDRIQVAVADLARTRSVVSRYTSTATVAVAGDSAYLTIPNPDGLQFDEHPYLRDLIADLRAAGIPLRSIVA

SEQ ID NO: 14303 - protein, 375 aa, Actinoplanes utahensis
MQRKHHALVAALVLVASGLFGLTLSSPAQADTRICDQYGSTTIGGRYVVMNNRWGTSAEQCITVTGTGFSIASQQGTGNTSGAPVSYPAVYYGCHYTNCSPGTTLPLRVSAISSATSSISYTFVSGATYDAAYDIWLDPRPNTTGVNAQEIMIWFNRQGSIQPIGSRVATATIGGRSWEVWQGSNGSNAVVSYVAPSPVSSWSFSVLDFINDVKNRGAITSSWYLTSIQAGFEPWIGGAGLAVTNFSAAVDGGGAPSGPGTPSSPSNPGTSGCQVTYAPNVWNTGYTADVTVANTGGGAVNGWALGFTLPAGQTITSSWNATLSGNSGAITARNVSFNGAIPAGGSTSFGFQGAYSGSFAKPASFTLNGTACAIG

SEQ ID NO: 14304 - protein, 471 aa, Actinoplanes utahensis
MRADTPAYDLDIRTDEKRIRAALADAARTPFWLEDPGRPVPLPALIGTIDTDLLIIGGGYCGLWTALQAKEADPARDVVLVEGEEIGWAASGRNGGFVEASLTHGQENGQRYFGEDLAVLEGLAEENFAGFRDSLTRHGIDAEWEENGSLAVATERHQVEELRAAPGRFYDREQLAGIVKSPLFRAGSFQETGAALVHPAKLAWGLKDACRRLGVRIYEHTPVTRLTDRGGTVRATTRMGVVRARQVVLATNGFPSLLRRNRMLTIPIYDYVLMTEPLTPAQLDEIGWHGRFGIGDCSRQFHYYRKSADNRILWGGYDAVYHRGGDIRPEFDQRPETFARLADHFLRTFPQLGEIRFTHAWGGMIDMSTRLAAFQGLAMGGKVAYASGFTGLGVAATRFAGAVMLDLLAGADTPRTRLRMATRRPMPIPPEPIAYPAVQVIRRAIARADRNGGRDGLILKTANLFGFSFDS

SEQ ID NO: 14305 - protein, 229 aa, Actinoplanes utahensis
MATTRGSSGRVRRRPTRSGVILEPSMIIDAALRLIEAPGGNALTVRRLGVELGADPSAIYRYFRDLDALLIAIADRLISETLAGFESGPDWRAALREMGRGVHDSMLRHPRLATLRASRFTAGPNELRADDIGIGLLLRAGFPAPDAVRHFRDFIDAVLALAAMDAAELAPGQEEADRQALAQAYATFSPEEYPNLAAVREHLPQIAVSAFPGVLDKLVDAIAVQLPAS

SEQ ID NO: 14306 - protein, 176 aa, Actinoplanes utahensis
MTDDGDARALILVEGISDRIALRTTAAARGRDLDADRVRIEPIGGAHAIGRYLRDLGPAAARLRVVGLCDRQEQWTFRAHLPADRYFVCDRDLEEELIRAVGVACVEELFAAERDLDRFHLFRSQPAWRGRPIEAQMHRFVRSSSRRNLRYAHLLAAAAARRDTRPGPLAALLDAV

SEQ ID NO: 14307 - protein, 156 aa, Actinoplanes utahensis
MVKPTLEPSGSGVDDHQRAVALAHRTRRRYWRQRALSSRLLHRLGELSAHSLAGLAVAGLVVAWLIIGVVISFPGWWENALYVTSSLITLTMVFTVQHTQARQAVALQRKLDELLRAVPAADNRLIALEEVPERELQELHHRDIASRENTPEAQWP

SEQ ID NO: 14308 - protein, 293 aa, Actinoplanes utahensis
MGTTLPVYRAGLNDSTRWERFEPRTGDIVISAPSKCGTTWLQMICALLILQEPALPAPLTTLSPWLDIRLRPIGDVTATLAAQRHRRFIKTHTPLDGLPRWPGVTYLVIGRDPRDVGVSIDHHRANLDGTVFERLLGGGAAPRRPASRRERILQWMHDERPPTVGMDTLRTMVHHLGQAWECRADPSVVLLHYAELSADLPGQMRALAGHLALDVPERSWPALVGAAGFDAMRGNAARLVPDERLGLFTSETAFFRSGRSGQWRDVLTDDDLAAYDSVLRSVAAPGFVEWLQR

SEQ ID NO: 14309 - protein, 279 aa, Actinoplanes utahensis
MAELLTVGEFSRLTHLTVKALRHYHDAGVLEPALVDPSTGYRYYTPEQVEVAQLVRRLREVRMPVAGVRQVVSAPDLPARESVIAAHLDVLRRELTATAAAVGSLRALLAGGDTAELIFRDTAEQHCLMIDGDVGQDDLTPWCAMAYPRLYAVAGRHGLVPRGPSGALYAFAWFQVGGRVTAFLPVAALPAADDGEQRAGILGEGVRWGILPAGRHAVAVHAGPCHDLDRTYAGLGRQVLAQGIGAPGPVREQYLVTSADTDDPDQLRTEVCWPVVAAG

SEQ ID NO: 14310 - protein, 126 aa, Actinoplanes utahensis
MPLSIAQIVIDCADAQKLAAFWAEALDRPVDPGAGPEFATIGHGAASTGNAPALMFIAVPEPKRGKNRLHFDLAARQVPDWRSEVDRLLTLGATRVDEHQAFGWHWITMRDPEGNEFDLGAGAATS

SEQ ID NO: 14311 - protein, 360 aa, Actinoplanes utahensis
MTERIRELLDEAVAELEPGYRDPVATVVRRGRAARRRTMLAATLAVMLLAGGLVAGRQMLAGPLTPTAAGTADSRPRLVDGKVRAGAVEIPVPAGWRVVTNDASQPCGDLTETIMLIVRNNRGCQYAPMEISVAAGRNPGGTVLFTAAEPFSSGDLITTPRSVTLAGGEPGWMPSSPEDAELAPGREGYHYSAELLLPWSDVFIQFRTDGPTARRILETFRSTPREGGALKVPTRVGSVDLTMPDSSGRLRPAGHGISSDPKTVNAVLGLLREQTAVVRDGDACAGTQQLSARLSLIAPGPSPSPSPDAMSFPVSSPKTTTVVIALGTKCQEAVSSDGGRVLLSDTALARLQGLMGIGAR

SEQ ID NO: 14312 - protein, 465 aa, Actinoplanes utahensis
MALRDPGRGAARPAGRRRRGRPARHRRPGSGGVAGTARRAARGTGAALLGQPVRAGDRRPAELLDRHGQEPGQPGHHRPAPRRRPPGRRVRPGRRAAPVTPPARVAGLDGVRGLLALYVVIHHCWLVCFPGYPANTGPWWGGWLIHGRLAVVAFIVLSGFSLALAPAGRGWRLGGLTDFARRRARRILPAYWAALLVSLAVATLAGPLPMIHRADGRIAVVYALMLQDFVPAPAPNGAFWSIAVEAALYLAFPLLILVRSRFGALATLGVSFVPVLIAGPAATTGFTWEMAPLFTLGLLAAGVAGRPPRLPWWRLTAFAATPVIALIAWRGPVWTEHHYFWIDLFAGPAVASLLIAVSARPARLLSARPTRGLGLASYSLYLLHVPVVALVSHQLGRSFPVLVAVAVPTAVLIAALFAMVFERAPFRRAGNTEQGERADPHHNAARGLETDSRIMVGPGAGSLRG

SEQ ID NO: 14313 - protein, 110 aa, Actinoplanes utahensis
MNAVFSRPEPRRATGLPADDHVRGFQERSVEFCLWIKAVGYSAEPVEYFDEVQGGLEVRFPLVASGGVSAPVEAAFDLVAPLDGVRIERGSTRRSSVASTGASPSLSPSR

SEQ ID NO: 14314 - protein, 413 aa, Actinoplanes utahensis
MIQRRKVIIGSLGVAAAATTVAGCSSKKDATTSGGTIWTQPVANNEQPAAAAAPVQVTVTPDAGATGVSPVKPITVAVTGGKLEAVTVTAGKEKVDGEIKPDGSWVSTEHLAYGKTYKVAVTATDSTGAKTEKSSSFSTIKPHATVRVTFQANAMSALQSGHTYGAGQPVIVAFSKAVNKELAEKAIEIKTSPSVEGKFYWADDKTVHWRPAKYWTAGSTVKVSVNALGVNLGKGVYGEKNASANFKIGRQLITIVDNRTHVAKVYIDGKVVRRMKCSLGMGGTTTGANGQKISFWTAGGPHVVLSKERKHDMSSASYGVSDPKNPYYYAAETIEYCTRITYSGEFLHAAPWNHQLGQANRSHGCINLSVDDAKWVYENFLVGDIVDVKNSPRELPIWNGLGDWTVSFDKYGR

SEQ ID NO: 14315 - protein, 507 aa, Actinoplanes utahensis
MARIPLGIALAAGTAAASALVAVAGPAAAKAPGADPVARADALVAARPAALHASAHDGFLRRQVIRSQGLTYAAYDRTYKGLSVKGGDLVVVTDSAGQTRYTSVAQNNAIGELTTVPAISESSAVTTARQLLKSVSGVEPTRLIVVTADGRAATLAWETTVNGRSATGASRLTVDVDAQTGKVLSTEEHVTEATGSGTGWINGSVSLNTTLSGSTYSLKDPSTTNLSCQDASTNKVFSGTDNVWGNGVGTSKETGCVDALYVAQKQKAMLSAWLGRNGQDGSGGAWPLRVGLNDQNAYYDGTQVQIGKNTAGKWIASLDVVGHELGHGIDDHTPGSLSKGGTQEFVADTFGAATEAYAANPNDPADYQVGEEVNLVGSGPIRYMYNPSLAGDSNCYSSSTPSQEVHAAAGPGNHWFYLLAQGSAGNGQPASPTCNGASVTGVGIQTAIKIMYNAMLLKTSSSSYAKYRVWTLQAAKNLYPGSCTQFNAVKAAWNAVSLPAQSGEPTC

SEQ ID NO: 14316 - protein, 251 aa, Actinoplanes utahensis
MTSASASGGPAERPRGSRRPAACLVRRRPMPGGRLTHRFGRSWAGWSAGVRQDDWVCAGAGPGLYAAVLMDADRTPRERLVAAARSLAAERGWDKVRMADVARAAGMSRQTVYNEFGDRAGVAQALAVWEIEQFTGAVRERLFAAGADVRGAAYAAILHTLREAAGNPLIRSILDSSADGLFPYLTTRSDLVLAAAATVIREWADACVPGVDAALAAESIVRLTVSHIVLPGESPEASAAALAEVFVRLLR

SEQ ID NO: 14317 - protein, 461 aa, Actinoplanes utahensis
MADLGADPGVAGSGEALVIGGHRLLSGSPSGPGTGWPPGVAAENRTKRGRRQSPSVTCGDVRARHATTPVRVSAGRGNRPLDTKAYFVKHLFMTAAVAGSWRDVKRPLWPLALVVPALPFAALLLARATGSGWAWWLTPVFILGVIPVIDLLVGDDRANPPEEAVPALQASPYYRWITFLFLPAQYAALVITCAAWTRQPGLGLVLTAGLVNGIAINTAHELGHKRETVERWLSKIALAPTGYGHFFVEHNRGHHVRVATPEDPASSRLGESFWRFWPRTVLGSLRSAWHLETSRHRLRGRSPWRLHNDILNAWLMTVVLFAALTAVFGPAILVFLVLQAVVGFSVLEAVNYLEHYGLLRQRTPTGRYEKVDPRHSWNSDRLTTNIFLFQLQRHSDHHANPQRRYQTLRTFEVSPQLPAGYATMLLLALVPPLWRRVMDHRVLDHYRGDATLANAAGRSAQ

SEQ ID NO: 14318 - protein, 862 aa, Actinoplanes utahensis
MTGVFPSSSGFPRPHPAASLFPVLTENPREDDVHLSPELHHFRQRPGRHPDRPSQRRPAPGRLGRPPRGDRPTAPAAGPCPRARRPGHGHPGGRRAGPGGGPRGGRRVPARTCRGRAAPAERSGRRRGRTGRPGGRDPGRGQREWRVTDWDEDVAQTFVNQDNAYVDTQIGVLHGDAHFYHVTGDAGPEEQFRVAVNYLDAGLAGEARRRIREAVMTGGLSSAEVAYRWALAVLSGRRLTDLSDEDLAALEHAFAMAGQYPSGRWWRSVAVIQGFVDALLALGPDGQPNPVACAEALRGHAALPPEDRLEIESHLGQFLAHILRDDADQRTDERVRAARLAGDRRDRVPKFFEPDPAPPVRKVPLQTPPGSAWRPVAGGAAIAALALWTLLAELGEVSILATLAVTALLGAGGWFAGRQLLERAYLASRRAAKEAELTRGERAPIERPGNQAPQEGFADAVSGLIDAAFARRQPADHSRDAFWQQTWGLRAALYGDLVDLYAHAGVPAATLAWLVNFHAGEIARRWRAGGLDEFRRDRPAAPLASPEFAGGLAALGGAAVIAVLTLLNSHFFGIVVTAGLLYLATRVGRGGAMVLYGERRRITLDTAEYAQRFDAETAAHQRRVAHLADRPTDVEMGRWLALDLAYFTRAVLLDSRLTGRDVVTQLVLTEAAAGSVRARILGGPFRHSAYTVLLFLLTEGGVRRVQARLEFASGKFVGERRDNFRYEAIVSAHVREVGVRFDDGRPRVLTDDESYALARTDKVVRREALLLNLIDGQKIPVLVDHFDPATVDTGREDPDQLARLAKDSSGVSSAVHVLEAIAVEGREWISLERTRMYRRLPRRRTVPGQPQGRELHAPPVRW

SEQ ID NO: 14319 - protein, 74 aa, Actinoplanes utahensis
MPDASRGIQQEGLVVECLRNATFRVELPNGHVVLAHISGKIRKNYIKILPYDRVLVEISPYDLTRGRILYRYRN

SEQ ID NO: 14320 - protein, 260 aa, Actinoplanes utahensis
METNTSDVIRVSERHWHALVDDEVAGRGQVSRRPDGRAFVSVDAWQAGVFRRLAETMLAELPRPLYTVVDEADLELLTAWERFGFGPRRREWEYVVPTSGGRVTPPPGVTVGPAEATSLQRLYAVVRAEVEAGIGWQNMPAEVLTRPLEPARYLVASMDGESVGLTRLGPMPRRPHIGLIAVRSSHRGRGIGRAMLAEVLADAHRCGVATASAEVNSANTAAVALFDGFGGRRAGSNLELVLRGPLTGSEPRAALRGRHA

SEQ ID NO: 14321 - protein, 249 aa, Actinoplanes utahensis
MESHHDHGHGHHHTPEPAWPAPAEWSAPSPASAPDWPSPSPSTDCPAADVSASPASTDSPAADRSASPASADSPAADRSAPPASAESSAADGSAPGPMEWVIAPPFTDPATPLTDTGSPAWNNQPAPAPWPEYTPAPWSDDAPAGGAAPATSGHHAVPAEWRNTGTVTPAAGTRRATLALLLAAAAVPLSLCAFGLPAGAAILLGALHLRHTTSGAPGRRRAITAICLSAVLLLPSIVLSIGFWSATSA

SEQ ID NO: 14322 - protein, 720 aa, Actinoplanes utahensis
MTRRNSSRRSIVAGLGVLGVAVAAGLMAPASNASAFAATSPANVVAFLTSITGGKIVSGVHNKGLNNPTEYTAEMQSITGKTPGLWGSELGFSAGDIPNRQKMINQAKAQWSAGSLVALTWHQCRPDVATCEFDTGDNPIVGSELSDAEWSSLLTDGSSLNNAYKAKMDQLVPFFQQLKDAGVPVLFRPLHEMNDGWAWWGGRSGSGGSAKLYQLTHDYFLSKGLTNIAWVWNVKDTGSASGAAAYYPGDNYVDVVTLDPWNNNFPTSAWYSAIVNIAHGVKPIALAELGNTPSAATLASQPNWTYFMIWSEYIAQCGCNSTIRSTFSNARVLNQGDFTIATDGGTTPPTSPPPTGGTGSIKSSSGKCVEVAGASTTNGTAVQINDCNGGPAQSWTVGTDGTIRALGKCLDVTGQYTANGTKIQLWDCNRQTNQKWTVRPDGHIISAASGRALDVPAGSTTNGTQLQIWDVNTNAWQKWTLSGGGSGPTTGPTTGPTTPPTGPGPYTPAQVLSGIQRNMTAARQVNSKPHINTMTRARNVNVYQVASGVYAYTSGMAIDTDGSDPDPDPDHQGETTFRDSNGQSLGAHHVPFYVLGDDCWDRVSPCPHFFYEEHGISGRQFALAFYQGKVIGAIFGDTQTANDQTTSDNDSRELGEASVKAASLLGIPSSGTSGGVDNGVTVAIFSGSSWIVNGTNADLNANAQAMVQKALNSLGAGMGR

SEQ ID NO: 14323 - protein, 129 aa, Actinoplanes utahensis
MSGDTAADPVSVELRCSFCAQPSSEVEKIIAGPGVYICNICVDLCNDILGSGDDDPLASAARMAARENGMTDAEILDLLPRIVAVGAQSEASIQRLVTILRNRKVTWARIGAALGITRQSAWERFSGEQ

SEQ ID NO: 14324 - protein, 476 aa, Actinoplanes utahensis
MAARRVWGFLGGTTVAVALAAVTYNSTFGNVFYVLLYGALTSAAWLAMRRVPAGPQRRPWLLVAVTQTLWFAGDATELAYYYLAKVPPVGLSDVCWLGGYAVLTVALVLMARRRAPGRLRGAVLDALTLTAAAALVSWQFLIEPSLRQGYSTGASIIPALYPVADVVVLAALLFIALSPGTRQAPTRLLFGAVALYLSIDLITNIGFHFLSDGLVARAGSLIMLGNALLTAACLHPKRDELTRSSAQVRVLHPSRVLFLGVAFLTAPVLTAVQDGLAKNAVATLLATAASTIFVLTRFTLAVREQERAQAQLSHQAHHDPLTGLANRAMLTDEMDRGRPTGVAVLYLDLDGFKQVNDRYGHEAGDLVLTTVANRLSAAVRGTDLVVRLGGDEFVLFCPDLPAPDAIRLAERVVADVARPIPFQGSQLDVGASIGIAAYGAGEQAHERDALRAADAAMYEAKRQGRGRWVLATTLAA

SEQ ID NO: 14325 - protein, 573 aa, Actinoplanes utahensis
MSIQFETGGVPGVFVASAGPLRAGLIFRVGEVDEPLARRGVTRLIEHLVRHAVTDADQDDATAPDLTEFHTEGSAEQVRAFLAGVCAALRELPADRLAVARDLVHAEYAARHDGAAAAMPIWRHGAHGYGLTAYPRFGLDGLQAEDLKIWTNDYFVRGNAALWVSGPHLPADLGVDLPAGDRRPAPATPTLPATPGYFPGPDGVIVWDAVVPRETAAVVFTQLLARALHRTLRVDGGLSYTATAGYAPRADGTALITALADGLPEKQDAVLAGLLGVLDRLRHGDIDEAELATVVTLCADGLTQAAGQGAGARSQAIDLLLGRPPAEPNELLSETRAVTRADVTRVARAAFAAGLLQKPGRPDTGPPGWTPAPVASTAPIDGDVFPSLADPARTRVIIGAEGASMVLGETAATVRFDACAAVLAWPDGARRLIGDDGVTVHLEPTMFHRLAAAIPTLDGRVPAGLRAAMAVRDPAAVPQPQLRLPTITAPAPPAGAFTGPPPSRWTWRGYLVNLVLCVGVIAGFATGALDPAQVRAPSGSHPLDNLPAVLIVVAMVGARAVWAARGLLRLYRH

SEQ ID NO: 14326 - protein, 333 aa, Actinoplanes utahensis
MGRPTGTDTLRGDHLCSALVLDSLAVRLSPSAPYPEARALLRDSDFRAADAADPQARTRLLRLYAAQAKQPVPADPADPTASAVRAFQLIEQGWNVRGGGRARTVTARQFRVFHRYLAEAERVLHAALTRTPHDLALWTASLLTVRGLEMGLDHARYRYACLSAFDPHHLPAQSQLLQQLCPKWSGSWPEAEAFVRAAMRAAPEGAHNAVLLVDYYLEKADFRGLRADIEEAAGRSVCHPAFARTVGWVQVVNSFALAFSKVGDRANARRMFTMLGPYASEYPWSTQSAEVTAAFRQARMRAFGLSGGLPGIADLLLVAAAPAVGVVRRYVTR

SEQ ID NO: 14327 - protein, 213 aa, Actinoplanes utahensis
MRVHNLAVSLDGFATGEGQTLEAPFGHAGGRLMQWFFPTRAFQSMNGQDGGSEGVDNAFAAAWGPGIGAEIMGRNKFGPQRGAWENEEWQGWWGDNPPFHTPVFVLTHHPRPTLKLEGGNVFHFVDASPAEVLAQAREAAGGLDVRIGGGPTTVRQFLEADLIDHLHVALVPIILGRGVRLWDGLESLEDRFTVESVASPSGVTHLTFTRRPA

SEQ ID NO: 14328 - protein, 153 aa, Actinoplanes utahensis
MTDTWWYDDDQLLHALSRAVAAPDRTPTEVFEAARAVFTWRTVDAELAELVHDSATRPPELAGLRAEEADLRTLSFEAPDLTIELGVAPAALLGQLVPAEPASLTLRLADGTTTAVPVDEDGCFRIAPRPRDRFTLTCETPAGRRIVTAALTL

SEQ ID NO: 14329 - protein, 208 aa, Actinoplanes utahensis
MTAVDRPRAGLPPEPADLVSLVTAAAAGDEAAWNALVARYASLVYATCRRWRLTEADAADVSQTVWLRLVENLSRLREPQALPGWLTTTTARECTRLYHCRQREHPEDVESRLARTPADDDGPVDRDLIAAERDAALRAAFAELPEHCRSLLGMLMRDEPVPYAEISTRLSMPCGAIGPTRSRCLDRLRRNPALRALLTDAEGNEEKK

SEQ ID NO: 14330 - protein, 297 aa, Actinoplanes utahensis
MVRPSAARRRRRPARGRGLPRGRRTLHDGLARLDGDRGRGATVAVCDTRLWGDGALAGAYLAPPAALLPPPGPDGVAFTAGHALFVTGIVLRSAPGAAVVVHPTLDDHARGTTWQFANDLVALAGRGVDVINVSAGFFTGDDQPALAVTTALRLLGPRTVVVAAAGNHGENEQDGRRPMWPAAYDEVVAVGALTPQGMPATFSPDAPWVDLLAPGVNVVSNYFGDAVSVVDPDTPGTTGRYPGLAAWSGTSFAAAWVSGLVAARIRPGETDAPAALHRLLQDTAAGTTATMIPKWSA

SEQ ID NO: 14331 - protein, 359 aa, Actinoplanes utahensis
MGRDPVAERLCDEALSSVDAQPRRAWGLAERALRTAQRAGDPESAAVAERARGLAALHLADLDTALRCERGAVRLAERAGNPTLAAEARMTLAFVLGRRGRTGDALAVIDQARADLHGVQRLRATAQRGAILQHAGRLGEALDAYRETLPRLRAAGDAVWTWRVLNNRGVLNVQRYRFAEALADLQDAERLSDAQDLRLLGATVRENLGFALSRQGEIPAALRYFEQAEQRYGVLGVNVSSLLLDRAELLLAVRLAPEARVVAEQAVAELTRTRGRFKLPEGHLLVATAAQLAGDCGAALPAARRAAAAFARQQRTDWSAVARLVALRCRLGLGLKVAVADLVRVARTLETAGWRLPAL

SEQ ID NO: 14332 - protein, 339 aa, Actinoplanes utahensis
MTALLGEAAIIEYVESAGRLFALLVADGRVLLRPLGPAARIAGPLERLPFAMRRAACGTGRGPEAAGQLLATLGGRLDDFLIGPVRDALGDRPVVLVPTGTLQSLPWGLLPSLNGRPVTVTPSATLWSQAAGRPRRTGRPLVVAGPDLPGSVTEAAQLGRLYPAATTLTGSAATAGAVLAALPHADIAHLAAHGSFRRDNPLFSCLRLADGPLTVHDLQTLPAVPELVVLAACDSGLSLVCPGDELLGFSAALLALGARSLIAAMLPVPDEAAAELMALVHQRLAAGEPPAVALAAAGRELTRSGGPAERVTAAGFVCLGAGLQPIRCGNSGSGRSAPD

SEQ ID NO: 14333 - protein, 525 aa, Actinoplanes utahensis
MRPNFRDLSLGFQLWAGFGSLALLMIVLAVSAGQVRANVDRQARQVVEQIDPKARSVALLQFRFSDAYGLQTAYTASDHELKHGFFTEAKAKVYAVLADVRKSASNDAQRQHAADFQAGLDDFMTIDDQVWTAVQQGRYAQATHISNVTESGPYLKAMDAAAKFDDSVTAERTAALATLTRTRSHATVRDLVLATGAVLLALLAATLLTRSIRRPLQRVVAVVDRLADGDLTQRTGVRRGDEIGRMSASLDRAIDRIAGTVTGITSHAEQVAAASSTLTGMSQALQADADQASQQIGIVADSAADVSRNLDTVAAGSEQMGAAIAEISRNTTEAAMVASTAVDTVGQAGATVSRLGTASAEIGEVVRTITTIAEQTNLLALNATIEAARAGEMGKGFAVVASEVKDLAQETARATDDITARVGSIQSQTGAAVQSIQQITEIIQRISEAQDTIAAAVEEQTATTGEMNRGVANAAVGSGEITENIAGVRDVADRTRDSADHSRRAADELTRLSQALNDLTRSFRT

SEQ ID NO: 14334 - protein, 193 aa, Actinoplanes utahensis
MPAPYAASRRRWFIAVLVLLVVLAVLTGIALHKLWNRPQASGATPTVTTSFGTPSTPPSSSASAVAGAAPQTASTHRVSGTTAPVVTRTTPSGPVIVYFRVSQQPTCPSGTDQVQYPGTPVTLAWKVTGVDKVTLSVDGPGIYDTYDANGSAEINFSCGGEANSYQSHSFLLTAAGKTRKLVVKARVNEIAHT

SEQ ID NO: 14335 - protein, 265 aa, Actinoplanes utahensis
MFVFGDDDPPRRLRLPGVLVLVVMTAGVVAVLWGPARRVDPPDVAAPPAAVSEAEIRAALIKSYRERFSTGGYGCSTAVLISVEGARPSPAELRRMVRESQLRDCTAEIGGDPRRVLLSPPDGWDSRAEQITAALDGVLCPAGTACSEWDPNNPEEPQPPDGDPNDPAEHHRPSDGDPSDPAEHHRPADADVAAVRRALAAIGHPEAEVRLVQPGDGGPSQTVMYGVPLGQQACAVSYAAIGRHPSRLGAVGALTTGRCLAPATG

SEQ ID NO: 14336 - protein, 479 aa, Actinoplanes utahensis
MSAAVLEAPADKVHATSLRAVWPAILGLSVVFLVEMLDNSVLNVALPRIARELNASTADLQWITSGYSLLFGGLMMAFGAVADRYGTRRMMLIGLSLFTLANLAVLLVRTPGELIAVRAVVGVTAAMTAPGTMALCFRLFDAENLLMRATSLIATVGLVGMAVGPTVGGLVLQVLPWQTLLVMNVPIAVLALVCIRRGIPADDPAARNSTPLDLPGALFGTATIILALWTATLAVEDGWSQAAPWLAGLGALACAAAFVVRERRTPHPLFDFALIKRPAVGASLAYEAALGLGMAAVSYSASLQLQVVWGWSPAEAALGNLPQVAVMLAIGPFVEKIVDRLTTRIAAPLGAGAVIGGLLIYALLGRYDYVWIAIALALTAAGMRVVATIAGVTVMRGLPEDQTSTGAALSDTSQEVAGSIGMAVIGTIVAAAVSGSLTGVDTSPAAAHTFENAVTVSTLALTAICTMLVVWAARRAAKA

SEQ ID NO: 14337 - protein, 239 aa, Actinoplanes utahensis
MRNTDRRADALSKERIIEAAVEMLDAAGESGLTFRALSAQLSTGAGAIYWHVANKGELLVAATDTMLAAAMAVEDAPRAPAAAIRAIALGVFDAVEAHPWIGDQMTRLSGQSSTLRIFERIGRHVQALGVPEAAQFDAASALLNYIQGVAAQNAALSRSVTQGTDRADVLETVSAMWASLDTDDFPFLRTIAGKLRDHDDREQFVAGIDLILAGIESRWPAGPRGLPRDVGGDRHPDRC

SEQ ID NO: 14338 - protein, 256 aa, Actinoplanes utahensis
MSIEPDTVPDMGIRYSALLRWGAALVTAGVASAGCGTVSLQGEYPARDAEQAARRLNDDFGYRDRLRQAEYIAATEIPTTAQGGNSEVGETPLAWSGRVFADEKATIDIRFAVRSPDSAPTEELTRCYRYTLQLYRYTSYDEIACPAVATPPAPSASPPLKLPPDAEARLSAALRDATPETLAGRVRAAFPHEGITVDTVTDKGTLVAAVGVAAERECTVVIRKTDGRTTPVAFRARQLEPGETGCRTSLYTHPAQ

SEQ ID NO: 14339 - protein, 177 aa, Actinoplanes utahensis
MIIRPMRPDDLLAVQDIERSAGEQFRDIGMPEIADDDPFTIDELTRYLRTGLAWVAADPDDRPVAYLIADPVDGCLHIEQVSVDRRHARQGLGRRLIDHLAAHAAAARIPALTLTTFTEVPWNAPYYRRCGFRQLGSAEITPGLRAVRAHEAALGLDRWPRACMRRTVEWSPAGSGT

SEQ ID NO: 14340 - protein, 402 aa, Actinoplanes utahensis
MLVIGLSARCALRSGRQRVPDGRKQMSYAAGVVSLATVIKQWGRIGCLGFGGPPAHIALFRQLCVDRRQWIDAREFEDAIAACNLLPGPASTQLAIYCAWRVRGRAGALVGGLAFIVPGLVAILALAALFLGDPPTWVRAAGAGAGSAVAAIALQSGAMLVPASWKRAVRVRWAAYLLLGAVAAATVGPWLVLVLIACGIAEIAAQRLPVSDQRPAPLVAVFGGAALLPLAWTALKVGALSYGGGFVIIPLMQADAVGQHHWMTAAEFLDAVALGQITPGPVVHTVAVVGYAAAGLLGGLLAAAVAFSPSFTFILLGAHRFDRLRGNRRVGAFLDGAGPAAIGAILGSAVPLLRALTEPWQYAVFAGAAALALALRRGPVLTLLAAATAGVAIVLAGGPLPR

SEQ ID NO: 14341 - protein, 108 aa, Actinoplanes utahensis
MPDVALPPLSAAAWALVGGSVVEALELAGALRRAKALPWKRPGEPRLPAYLLSVVLRLAAGAGLAAVFGADGQLGGPFAAGSLGITAPLMVEKMLRQVGKPEVEDGTA

SEQ ID NO: 14342 - protein, 285 aa, Actinoplanes utahensis
MPAGDPSFGRQLLLALARSTPAFHPAREARRADSTLLDAVARRTPAFTGDQPHPDPVPFRGTFAFARPTMARRGSRSLAPLLAGLATVLFAAVGSAVLVAGAGGHQPTLPLPGLTDATGTATTGGPPPDASASPTGSAAAQGAAMNQLLDRSSASRAELNAAIIAVLACEKVDDAVSRLQAVGVERDEQRSTLASLDLSAIPSGEAARDALSAGLTHSLNSDVAYVKWARERNSAGCADTPAAKVYRQAADHESASSAVAKEQFLALWNPIAVSLGLPSRGRQDL

SEQ ID NO: 14343 - protein, 31 aa, Actinoplanes utahensis
MVGAGAVIAKDVPPLSVVTATSFVERKRLGE

SEQ ID NO: 14344 - protein, 708 aa, Actinoplanes utahensis
MSAHPGAVPVTTPPEPPPLPTAQALQLGAHNVQYNFSGGAVPVTWPCRAGVVPPEADCRQSRPADQTLARPSASREGTVAQVVTGMGGVGKTQLVAHLAHDLWRKREVDLLVWITATSRRNLVAGYAEAALRVFGIEEGDVDRAAQRFLTWLAEPHGHRWLIVLDDVSDPADLRYLWPPAEAFGRTVVTSRRRDNALWAGRQLIELTVFRPAEAEVYLKAKLAARPAALDGAADLAAALGHHPLALAQAAAYILDRGPRTSCSAYRKLLTGRRRRLSDLAPDALPDQQGVPMSAIWTLSIEQAARLAPVGLAQPVLELAALLDPNGIPISILTTTSVSAFCAERVDREIDADTIDEALRLLARFNLLSLDDATETAHIHAMVQRAVRETLTPDARRRLSTCLADAVFEQWRTMRRREDAMAANVIALVEATDLDLWDPEGNLHPVLYRTLHRIAGEGEQPSTSFLDHLYRRTVEHVGIDHLSTLRLRIYLAVRRGASGDMSGAVDDFEALVGDCVRTLGQDHDETLNVRRNLGEHKARAGDTIGGIADLEAVLVDCLRIQGADHPNTLGARFNLAKWRGHTGDPLRSAGEFDNLVAALTRELGPDDSNTLAARWNAASFRGMAGEGRPAVEMFTALTRDYVRLAGRNHPVTLEARLELAKWRAVAGDTSDAIADLRALVEDMVRVLGADHAQTRKAQDDLDGLVNSPI

SEQ ID NO: 14345 - protein, 87 aa, Actinoplanes utahensis
MTLPRPGDILRVGSAASVQFRKPILLRVIQVHDWTTYDGWIWISGYSIDPAGRAIERRTIFVQFDGLRTIPANRLPIADAADPASAE

SEQ ID NO: 14346 - protein, 284 aa, Actinoplanes utahensis
MARPIGPTIPRWQLGEQLSQLRTSAGKSQQDAANRLGCSISKIQKIEGGEVGMKPVELEALLVLYGAPDALSGQLQELRTLGAQRGWWSKYGAVSAPFSTFLGLESAATKIRIFEPLMVHGLLQTEAYAHALTEASNPSMPDTEVDRQVRIRLERQDRVFLEEPPEIWVVLDEAVLRRQIGSPQVMAEQLNHLLRLPKRVTVQVVPFANGSYPGTLGALTLFEFAEELHSPVAYVESQAGNLYLEREDDLARSNVSLNHITAAALSKQESRELIAAVARQLVPQ

SEQ ID NO: 14347 - protein, 72 aa, Actinoplanes utahensis
MDKYHVNLADAQWRKSTKSNANGGCVEIAQVDGFVAIRDSRNPDREPLIFDATEWDCFLDGVAKGEFPVPRP

SEQ ID NO: 14348 - protein, 748 aa, Actinoplanes utahensis
MAATLGSRKRKIDRTVRMTVFLIGVLVLISSVVTSVLAVRRGRVDAQDHALDVTLGRQVEALQNYFERARAIDAVLADNPVFSDYYAAPATPAKLRRVNEALGYLETLFPGRIGEACFIDSSGTEIARVVDSTPAGPDDLSRDEDDNAFFAPTLALEPGQVYQAKEYESTDTHNAVISNSTTVRAAGHTGIVHFEIALDSFRMAGTTGSIAASIVDAQTGHVLVDTRTGSIPAALPPGAGDHGVTTLGGRRIAYQRIHATRGNANDWYLAVSAPAFGRGWTHGLSIGSLALLLGALLIILISAVSGWRYLTAVRRSATYDRLTGLPNRTLLADRLGAALDGGQRAAVLLFDLQGFKDVNDLLGTRHGDLLLTQVARRLSAAVPSGALLARVGADDFAVLLPGGDLAGAHRVADDLLQVLRPAFTLGDVSLDVEVSAGIAAGPGHGDDAETLLRHAGSALQLATEQATGVHEYEPGQDADPAHRLQLLADLRRALDTDDQLTVHYQPKIELDGERVAGVEALIRWEHPDRGRIPPDSFIPIAETTSLIHPLTTRVLEIAVRQAAAWRRDGRLLPVAVNLSTRCLLNPSFPDQIFQLLRSYDVPAAVLELEVTESLVMTDPERCLAVLHALHAGGIRLSVDDFGTGHSSMSYLQRLPVDELKIDKSFVQGMATSHGDAVLVRTAVSLGHNLGLSVVAEGVEDATAVAALRELGCDIAQGYHYARPMPAADFDRWHAAFLGKQAADLQVAQ

SEQ ID NO: 14349 - protein, 326 aa, Actinoplanes utahensis
MRPKLLAALAALTVTLPIGSSAQAAPDPAPNGRISLADLREATLDVPAWPADNVRGPSGRLHFHRGQVPVEGGSVAEGQPPYGDSILILSVAYGDVDHDGADETIVTFGCLIEGGSKQVVVYDRDATGAIISLGRVAATTGPVRDIRADSPKVTGGVLTTAVADYQRCCDDRTPQIWQTRGYALRSGKFVQVSGPRRMPVNPHVTDASITAGPLTLGPEKDGFRYGTTIVTVTRHRGARPEQFTLSFFPPEGLERSGAGWPKVTEEPDWFRVTVPAPPSDDTVSYPFTFRRPAAATGGELDIELGTVPEMGLAVPWTADAAAPIRP

SEQ ID NO: 14350 - protein, 331 aa, Actinoplanes utahensis
MLAALADANQGHAESYGRDPLTARLQDVFRDHFGPTATTYPVVTGTGANVVALQAATDRWGAVICVDTAHIHVDECGAPERVGGLKLLPVPAVHGKLTVAAIRREAWGFDDEHRARPQVVSLAQATESGTVYTPDEVGEIAAFAHEHGMVVHLDGARIANAAAHLGVPLRAFTTDAGVDILSFGGTKNGMLFGEAVVVLDPRLDRGLEHLRMSSMQLMSKMRFASAQFLALLQGDLWLRGARHANAMATRLADRVRDLPGLTIDRPVQANAVFARLPADALATLHEQFLFHDWPSGEARWMTSFDTTAADVDRLADAIRAACPNRVNYSQR

SEQ ID NO: 14351 - protein, 137 aa, Actinoplanes utahensis
MTQKSLRLVGYWDDPAAPDGWPDVRDFVCADVAAQERDAVIAYLRSGTVVVAMSGISVCHLCGVGNGSTELTDGEHLIWPAGLVHYVESHDVHLPEEILAITRRGPARPVDPRAFERALLETHELTVDEQWWRALRR

SEQ ID NO: 14352 - protein, 133 aa, Actinoplanes utahensis
MGAPVVTVWVDGWQLECCGEPFAVGQEVSWVLRDLDREWLASFLGGGLAGSVDKAEEHHGNEPEGVPPTVGTVVSIEAVHCRYAPLSPDVNGLHPVAGSGTTVSVRNTAVAGQDRGDLTFVGYLVGLAVDEGA

SEQ ID NO: 14353 - protein, 174 aa, Actinoplanes utahensis
MGSELGAASLTYREVGATRAESMPEGYGHVTRDVRLGDGPEVFRRAGAALLGWRMHEEAGLTVVHADGRAAAGVNVVLRVGGSLIGLAIPCRVVYAVDEPDRCGFAYGTLPGHPETGEEAFMLAVTGTGEVRFRVRAFSRPASLMARVGGPVTRLVQQYATDRYVTALRRLAHR

SEQ ID NO: 14354 - protein, 191 aa, Actinoplanes utahensis
MFIAASVLALVALASNVTTVSQLEGRANTLLAARMTLSELVNAGALWAGLGVLSGWLVRGRAQAVVAGIIALLTACVVHYGVGLALGMFDAGVWADNSSWFLAAVILGGPLGLVGAIARRPDGWGIGARLVVPVGAVIQPFYLGLFTTPAALPWPDRAADFITGLTLVTAGATGGFWILATGRRQRGSGEP

SEQ ID NO: 14355 - protein, 199 aa, Actinoplanes utahensis
MGTISRQRPLRRIRPKSMIHIPKFRHRDRTRPWRPYRIGLGNGVARLGKCMEKQRKRRLARLGGALVVIVVVGLAGACSRGEQTSAAASVRPAAATVAVPATPDPATATPTREASRKPATRKAPAMVRVPDGVGRDYQSAQDIWRAAGLIVAPAKDDTGAHRLPVIDANWVVLAQDRKAGSRVRKGSLITATVKKYSDD

SEQ ID NO: 14356 - protein, 130 aa, Actinoplanes utahensis
MKAFREAVEARDSAAIEALLADNVVFTSPVAHKPYPGKPVTAAILRAVLRVFEDFRYVTELAGSDERDHALVFRATVGGRELTGCDFLHLNADGLIDEFMVMVRPLSAAQALAEAMAAQFPQIQQEAAQG

SEQ ID NO: 14357 - protein, 126 aa, Actinoplanes utahensis
MSIPAEIIASKQISLTTFRKDGTPVPTAVWHVASGDTITTVSAAAAGKVKRIRNNPRVEITACDVRGNVPPGAQTIAGTAVLLPDSQTDAARRLLESRYVTARIGGTLARLFHIKRPAAIGIVITV

SEQ ID NO: 14358 - protein, 146 aa, Actinoplanes utahensis
MASDLDDIDRRILAELTRDGRLPIRQLAETLHISRANAYARVQRLREAGVIRGFRAEIDHVAAGMTTSAYVTVNLHQAEWREVGERLRHLPGVVHIALVGGEFDVILLVRARDNTDLRRLVLDEIQGMPGVVNTRTLLVFEEFDLA

SEQ ID NO: 14359 - protein, 359 aa, Actinoplanes utahensis
MTPDPRRLLPSDSPVTLIAPSGAAVGEVPEDAVLLRSLAALITARRLNDQAYALVRQGRLAVYPSSHGQEACQVAAAQVLDATDWLFPTYRDTVAAVVKGVDPVEALSLLKGDWHCGYDPYEHRVAPHATPLATQLPHAVGVAHAARLRGEPTVVMAMCGDGGTSEGDFHEALNFAAVFHAPVVFFVQNNEYAISVPLSRQSAAPSLAHKGIGYGIPGERVDGNDVAALLSVLGAAVARARAGEGPQLVEAHTYRMQAHTNADDASRYRDEAEVAAWVERDPITRLRTHLRDRGALTDEIEAGFTADAERAAAHLRDGLHRDVTPNPDDLFAYVYATPTPQLREQAALVADELSREGAL

SEQ ID NO: 14360 - protein, 330 aa, Actinoplanes utahensis
MATVVHEKLSMAQALNQALRDAMADDPTVVLFGEDVGALGGVFRITDGLTAEFGDTRCFDTPLAESGIVGMAVGMAMNGMRPIVEMQFDAFAYPAFEQIVSHVAKMRNRTRGRVSLPMVIRVPYAGGIGGVEHHCDSSEAYYAHTPGLKVVAPATPGDAYALLRAAIEDPDPVVFLEPKKLYWSKEEIEFPVRAPGIGSAVIRRAGTDATLIAYGPSVPVALEAAAAAEVEGRSLQVVDLRSIVPFDDATVCAAVASTGRAVVVAESAGFAGVSAEVVARITERCFTSLAAPIRRVTGFDIPYPPPKLEHFQLPGVDRVLDAVDDLNWEQ

SEQ ID NO: 14361 - protein, 216 aa, Actinoplanes utahensis
MILFTGDVGGPAQDAALGPRLLRDGLGDARDILRVYSPAPTAAFSRRDTLRPGYDRALLAVRASDFDPVVRPQGGSLAAYHPGSVVIDHVHRSGPEAPAPAERFERYAAMHAALLAGLGVDARIGPVPGEYCPGEYSLHVGAAKIAGSAQRVTRDGWLFSTVIQVRGADRLRGVLTPAYRRLGYDFDPGTVGAIEDTAPGLTVEAVTAAVLAAYEV

SEQ ID NO: 14362 - protein, 327 aa, Actinoplanes utahensis
MPLKAELTSADLLEIRQTALGEADPLGLAADLAEAAENGRLADPADAGAALVLAAEIAETRSRFEAALRYAERAVETYGDRQDSPAAGARAVRARLLFHIGRGDEAMAELEALRPTLEQYPDAPAYLSVALEIGGRLRVAEQWLSEAVQAALAERGPEPSGPDEAGQLLFLLQQRHRVRHALNLPHDAHDNLAQRLEDRLAGAGATTGDQLLFFPESELGKVLAEWPGLADAYGADWTAHRARLEGLLARLSAAGQANLAALRGSAEGLRKAAGRDGDPADAEVRARYARQIATGSGPIPWPPERNGACWCGSGTKYKKCCLPRGRA

SEQ ID NO: 14363 - protein, 1150 aa, Actinoplanes utahensis
MASGVISRTVVTAGAVVLLAAMVAAPAAARSPGSRVVQLAAGNGHTCALLSDTGAYCWGRGAEGQLGDGSTVYRSGPVAIAAPHGVSFTQLTAGQAHTCGVGSNAKAYCWGMGDYGQLGDGATANRSSPVAVAGPAGVGFTELAAGDRHTCALGSDTRTYCWGIGNDGQLGDGATANRSSPVEVATPPGVSFTELAAGVYHTCALASDTGTYCWGMGGMGQLGDGGTVNRSSPVAVAAPPGVTFTQLAAGGFHTCGLGSDTRTYCWGLDETGQLGDGGTARWSRPVEVAVPAGVTFTRLTAGSNHTCALGSDTRTYCWGYGYYGQVGDGGTVNRSSPVEVAVPAGVTLSRLTAGWYHTCALGSDSTVYCWGLNETGQLGDGSITDRSSPVGMPPLPSPAGPLPPTGVSATAGDREIAVSWTVPADLGSGALTGYTATTSPGGNSCTSVTTACLITGLTNGTAYTVAVTATTTVGTSAASDPSASVTPVAGPLPPTGVSATADDREIAVSWTVPADLGSGTLTRYTATTSPGGNTCTSGTATTCTITGLTNGTAYTVTVTATTTVGTSTASGPSAPVTPVAGPLRPSGVSATAGDRQLVVSWTVPVDLGSGRLTGYIATTSPGGKTCASVTATTCTITGLVNGTAYTVTVTATTTVGTSAASDPSAPVTPAAGPLPPTGVTATAGDGQLVVSWTAPVDLGSGRLTGYTATTSPGGSTCASVIATTCTITGLVNDTAYTVAVTATTTVGTSDASVPSAAVTPAAGPPAPTGVTATAGDKAITVSWISADTGGQTPTKYTATASPGGKTCTISSSSSHSGLCTINGLTNGTAYTVTMTATTKAGTSPLSSPSAPATPAAVPPADRPQPPVVTAVKPQSEAIAVSWQPGSLGAGTLLGYTASAAATNDPCSSASTPCITTRTTGKLGAIHLTTTTADPSTCTSTDTDAQACTITGLTNGVSYAITVVAHTTAGDSGVDLSGPVVTVTPGDRTLVHGSRFTTAVTATDPSGIGRSYLTGADGAGLPFSYPSATVPAGADGDRTVTWIVLDSLGNQSTASSTVIVDNTAPAVTFGKAPRNGARIARTTTITAAASDRNGIARVQLLVNGKPVADDTRAAFAFVLNPAKYGRKFTVQIRAYDRAGNSRSTSRRTYHR

SEQ ID NO: 14364 - protein, 168 aa, Actinoplanes utahensis
MLRVMTDEAQPRWLDDDQRRTWMTLIGLMARLPAALDVQLQRDAQLTHFEYQVLAGLSMAPEHTLRMSALAAFCEGSLPRLSQVVTRLEKRGWVRRTPDPADGRYTLAVLTDSGWQKVVETAPGHVAEVQRLIFDPLTRAQQRHLRDIGRRIVRTIDPDDPCLTDDPD

SEQ ID NO: 14365 - protein, 584 aa, Actinoplanes utahensis
MARRPVPVGAVDAETAGHRDRLGALGERARGAVRQRGRHPALLRLRRLPSALLHAAVRQSGRHRPGPPGGRDTRSDRAGAPVREPRSRPRGVHPDDGHVPGGRRSGRAAVDAQPRPASAARPRSAAARIAGRGHSRHRLRIHDAQFRGDARSRTGRAHPGLRRLGGGRAGPRRRGRAHRLPGESARRRRRPSDRRPLCAAAADPGRGGGSGQRGVGHRPDRVRQLDPVGQRRVSGRSGPPIVVIGAGQAGLSAAYHLKRRGLEFVVLDAADGPGGAWRERWESLRMATVNGIFDLPGFPRAQGDPQEPSRTAVPRYFADFERANGLRVRRPVRVIDVREKGLDLVVATDRGQWSAAAVINATGTWTNPVLPHYPGQETFAGRQLHTREYVSAEEFRGRRVAVVGGGISAVQQLEEISRVAATFWYTRREPVFRTDAFTPEVAGRETIAKVVADVEAGRPTGSVVSYTGLAWTPYALAARQRGALERRPMFTAIEPHGVRAADGSFTSVEVILWATGFKAALAHLDGLHLRNARGGIAMAGTQVAGEPRVHLIGFGPSQSTVGANRAGREAAVTLARHLAARSGH

SEQ ID NO: 14366 - protein, 483 aa, Actinoplanes utahensis
MSGAASRWVAALTLASVSALLPTSAQAAPLPAASTCAGDTGTAADRVVADRLRPSMTGRRLGTAVSPRAVACARAIIGIVQQRGLGPRAAVIAVTTAITESTLTNHVVSTDHDSLGLFEQRPSQGWGRAAQLVDPVYATNAFLTAMLRKFPGDSWMGGDIGAICQRVQTSALPGAYAFEVHDAQLIVSALWAVAPDPAPAVPTAAATASASAAASGPFTTALASARPQLGALNGRHGLAMADWNGDKHPDLMIINGVGAATGKTEIRIMDGATNFSRLLLITATALGPTDERHAYAVTDYNGDGKPDLVVTQKSGTASGHTEVRVVDGASNFQRLLVETATVLGPTDDRYQFSVADWNADGHPDLLATQTTGTASGKVEVQVLDGATNFQQASPAVVTAQPAGDGVRVAVTDWNGDRKPDLVTTVKTDLSVLDGAAGLTKTLATAKVPGDSREQVLTDWNADGKQDLAAVQTEGTAEISVLGG

SEQ ID NO: 14367 - protein, 309 aa, Actinoplanes utahensis
MPMNTSAPSSCSPTVSARPGYRPALTVQFHQVRLPASPVTPRPAPPPGPHHCRPRSYPFPASSKRAWIPAANHVQRSRGGRPGRPVSAFQLTKRLCDLGLNPAQSRSTALFDLATELAAAILARMLGIHISVAAAWQRASAGDWTTYAADVSRRADTIGKISKETWAHVHNYRFKRQTNKIGIFAGLTAEALRQSTLPVKADHISDHIWLDTSHVTDGFRGTPLRLSQNEVGWLRTGLLHVADDITRAEPTAHVTVVIHALEIIEVDYIEPALALAIAGWAAQEFGFTDRPADIRLDDQTNQYVVSWTG

SEQ ID NO: 14368 - protein, 513 aa, Actinoplanes utahensis
MVIPPSANTADQIPICSGVSPTTSAPNSTMYEVTIESAIPSSRTAANSASEGTHRSYRLEPSKETDFPRPGATPVTIRPNRKNGCAAGIASKPMHPILVVAASLLLCAITAALLRRHLRPAVESACRSLIPHLPGLVRRAARWCRRHVDPAVLRSGLVTAVAAGIAWAAAGTLHLAGPVTAAISATLSVQLSSHASVREGTQRLIGTLAGLGLTVAVWGVFGLTPWTIAAITGCGLAAGRLLRLGESSVTVPATSLGILVGGSAVTEAYVWERIAATALGIVVGAILSPLVGGMTPLERAAWNLDRLSGEIARLLAALGDGVRDGYTREQAEQWLARSRDLGADFDEAATAVDDMIRHAHWSLTTPVAKVTPLRDTLHALEHGVQQVNSVARSMFDAAATPHAPVIPAPIAPVLTAAAEAFAERSDDRRHEKLESLRDARHQTLRTVRTELDDTGVLVLTGSIITDIDRMAGSLARSAPALSIGLREPGPGIPAVSEVLPAVRLILKKTSSRS

SEQ ID NO: 14369 - protein, 625 aa, Actinoplanes utahensis
MSFDHRALFCSAPVAMLVLDPELVIVEVNDDYLSATMRERADLIGQSVFAAFPENPADPGAGSVAQLASSLDRVRRDGVADILPIQQYDIPQPGGGFQIRFWSAVNAPVFAADGTVSLIIHRVTDVTEYMLAKEGHALRVLTGELESEIFARRQAQERITMMQAVADSLVVAIIAGDPTGRPAMCNQAALGLVGDLVRGRALEQWPEPLRPLLARVLHGEVVREAEVELRLPGRPRQILRMNARPLTGQPSLAVVVGLRDVTARRLASRLQEGELEITHLIANGQPSTGTLRRVMAIAGASIGWQATEFWAVDEVTRTLRREAHWGESARSGPDLPAQTLRGAGPRWEDGALAVPVPAGAEPLGVLVCYAGDDDVPEELRAAVVTGIGARLGEWLQRRRAERLAAELARTRDEYIALVGHELRTPLTSIQAHTELLLDDPGLSDDQRDALGVMRRNTESLRTIVLRLLDVAGLRWGHIELHRKPVDLAVLVREAAAGHSGVAIGAVDPLIVDGDRGRLGEVLDELIGNARDWAAEGTVVTVGVHADGGAAAVTVTNRGTPIAAHERGRLFDLFFRGDAARHGGMRGNGLGLTVARAIVEQHGGTLTVGEPDGGMTTFTVRLPLTA

SEQ ID NO: 14370 - protein, 56 aa, Actinoplanes utahensis
MTLTVPSPAKVIATWNTTASYPNAQTLVAKPNGSGNSFGLTIQTNGNGTWPAVSCG

SEQ ID NO: 14371 - protein, 224 aa, Actinoplanes utahensis
MAQRFVQRELTMRIMLAAVATVLTAATGFVAVEVTAAQAATCSGYVGLTFDDGPTAGNTQNLLATLRANGLRATMFNEGQHAAANPALVKAQIDAGMQVGNHSYTHPHLTQQSQATIDAEISRTQSAIANAGGGTPKLFRPPYGETNATLKSVEQKYGLTEIIWDVDSQDWNGASVDAIVAANARLTNGQIILMHDWPANTVAAIPRIAQGLASRGLCAGVISP

SEQ ID NO: 14372 - protein, 329 aa, Actinoplanes utahensis
MPDAPTSSRPRARLKATLAAACTVVAAVAGTMLASSPAHADTTVSSNQTGTNNGYYYSFWKDSGNVSMTMGAGGQYSTQWSSVNNFVAGKGWSTGARRAVSYSGSFNPSGNAYLSLYGWTTSPLVEYYIVDNWGTYRPTGTYMGTVTSDGGTYDIYRTQRVNQPSIQGTATFYQYWSVRQSKRTGGTITTGNHFDAWASKGMNLGTFNYQILATEGYQSSGNSNITVGGTGGSTGGGGSTGGGCTATLSAGQQWSDRYNLNVTVSGSSNWTVTLNIPSPAKSIATWNTAASYPSAQTLVAKPNGSGNTFGVTIQANGNWTWPNVSCSGS

SEQ ID NO: 14373 - protein, 184 aa, Actinoplanes utahensis
MSIAIPSSLVPDGSGVPSVCSRHGEAPAVQKPVKFWSKPPAWALILILFGALPYLIVVWALRKEVRSQAWPFCSECVKLHKNRLLIGLGLIAVLPISLAFPRGDSFGTVVLLALVVALAGAAVLARGSYRMLPGGVVSRDGAQVDFPNSHPAFDAAAQAAYHQAAQRYAAWQAGQHAPYQAPQA

SEQ ID NO: 14374 - protein, 315 aa, Actinoplanes utahensis
MALKVFQPIPWLDPLLSTPGHRGRASPSRPASRRSQPLRRMKRLGAAEPAYGEGMDFAGSVPANYDRYLGPLLFQPFARDLASRLADRSPSRVLELAAGTGIVTAEVARALPDAVIVATDLSQAMLDVAAARRETAGVRFEAVDAQNLPFGDDSFDAVCCQFGVMFLPDKARAYAEMRRVLRPGGGLLFNVWERIEDSPIAATVEAALQNCFPDDPPQFLSRVPHGYHDATAIRDAVRAAAFGEVDVVTVSLPSVSPSAGDAAIGFCQGTPIRHEIVSRGGDLAAVTESVRAALTDKFGTGEVRADMAALVVTAC

SEQ ID NO: 14375 - protein, 900 aa, Actinoplanes utahensis
MVGRERELRRLAQLAAAREPAVAVIAGEPGIGKTRLVQELLATLPPETVVLVGQAEPGSLSRPYEVLLDAIDGRPEVDEDQLAALADPRRSPVQRLHTGLAIVADLIGDSPAVIVFEDLHWADSESAALFERIADQHGPRLLIGTYRPGDVTRRQPVASLLAQLERRHAVTHVRLDRLSPAQTAALLAAATGAPAPLRAATALHHRTGGNPFFLEELLRALPGYDVEGLVEQPLPWSLADVLRRQVDDLDPVSHRIVEAATVLGHRIPFDLLADVTGADEDELIRVLRDLVTRGVLVESGDDEFAFRHALLREAIADQMLSRQRRRLHEAALDSLLRGGGSDPAMVAHHARGAGRYDDLVQAARDGAGLYLSIGSAYQALQLAEMGLDEVPDDPGLLASAARAAWLAGLLDDALRYGRRWRDLATTSSDRAESLYLLVRIAWESRDAAEMRTLTEAIATLIAQLPPGADQAWAMTAIAQSAYLRDELDDALLWCDRALALADEFELPGVRLAALVEKGSTLTERPQTATEGRAMLSGLIDDLEAAGEWVLAARALAALVVGVPPTSPIEHAETLERMRIDAERAGFESLAVATYYQGRARLAQRAGDLDAAIAALEEGREQDIGYRRRGRWADFHAVFLAGLYLEAGHLDRVEQILADLRELPNNLPTAIPGLTFNLACRRGDLPGASMALNDLFAALAGQSWRSGEQAHDLVSAALELGLPAERLDEMVATLLDAEVWDAYRTLVDAQVAEAHGRHALALDGYLSITDAHILGPAARGTVHVGAARCLLAAGRPAEAEVHAKAAATALSRWHGWRVTRLDEVRARLGMTPVDASAVTGPAALTPREREVAVLISDGLTNTELARRLYISPKTAAVHVSNILRKLGVSSRTEVADLVNGT

SEQ ID NO: 14376 - protein, 84 aa, Actinoplanes utahensis
MWAPRPDGEHGSVGKRGRQTMLFHPFMMLGLARERRHELIAEADRERLLAAARRSRRAGKRGAVRGRPAGTLSACEPSVAVPAR

SEQ ID NO: 14377 - protein, 889 aa, Actinoplanes utahensis
MLFDQLRRRRPVAAPADSPVQELPRWKLTPERRDRYRHDVFEQELDEVLGAGSLADGTVSTDFLRRRCLRERDALGTPAQDAWQIVDRRLVDRARVRDRLDAGALIAYEWAFTPGLRRLILSLGMALWLLAFAYAGPGEHRLDYADPVLLWAAGVLVTGSAAASIAEFRGVRHPGLFVTQAFATALAAGLTAVAGMQVKTVAIQQSGLVPVTVVMITTVVLAVLLVAFQSWGHVDRHWSTARLADLRVPVVTGAILIGLISLTALGTILILGAGTANRRLDVVRPELWLAVPGSVILTLNLLAGLFGYSSTPFEIVDSRWRTAEREWREMLRNRILLPLLRRMVNDARPSYDTTLYVTRPHGLSQAFDPIYEVPTRARERLEKILTMLPGGSVGLAGPRGVGKSTILASFCEHRAESAGTIRVLVSAPVDYAPRDFLLHLYAQICRAALGLHDGHRPPPDPIHWLSARRPLWAGSLLAGLTGAAGLGILILSGSQYRLGTSQIIAVIMLLVATGLGAHLAARRAPRPSSGYAPEDTLRDAALERLREIEYQQSIAGEYSGAVKVVPAGLESSLKRSTGFVRQQLSLPEIVDSLRRFLKLAAAQPRPAGGPALVIGIDELDKIEDETRAQQFLNDIKSIFGVAGCHFLVSVSEDAMASFERRGLPFRDVFDSAFDEIASIPYLAFKESSDLVGRRTTEIPIPFKGLAFCLSGGLPRDLIRAARTMVEISEKGSRDLPAIAARLVARDLTGKADAVAAAIRKVDAEPATSRLMLWCRAIAGRIADDGDFTAAMDDLKCIDMWGREEANRAALRRLAREITAYAYYCRTLVGFFALPQSAGILAAYDELAAIRRAMAANPLVGWTLTSEFRQRRRMPEVYPPDALTVLPAKV

SEQ ID NO: 14378 - protein, 473 aa, Actinoplanes utahensis
MTTLRSAWVALAGLSAVFLFEMLDNSILNVALPTIGRELHASTIGLQWVTGAYAVVFGGLMLLFGAVADRFGRRRTMLVGLILLGVASLATAFVTTAGQLIAVRALMGVAAAMTTPGSMALAFRLFARDDLRVRATTLISTVGLVGLAVGPTTGGFVLSVAPWQTLLLINVPIAALAFAGVRTGIAADDPADLHRAPVDVAGAVLCTLTVVVALIAPTLFVDEGAGGWQPWAATAAAGLGALLFVLREHTAAHPLLDLALVARPLVATGLAYKAAAGMAVAGLGYLVTLQLQLAWGWSPAHAALGMLPQVVVLIGGGVYVNPFVTWAGLERAAWLSSLAVVAGLAVFGVFSRFGYLWVALALVLVSAGLRVVGVVAAMNVLRGLPENRTTIGAALVDTSSEVTSGAGIAVTGTILAAVFTGSITAGQWTAQQTTQFATAMTTAGLVLTAMAAALVGWAIVRTRAARTALSSVR

SEQ ID NO: 14379 - protein, 242 aa, Actinoplanes utahensis
MAPTPQERRAARHQLGGAPSAPAARRGPSGGRKKPITVDAIIDTAFGIIETEGYEALTMRRLAVALETGPSSLYAHVVNKEDLDELLIGRLCAEIELPEPDPAGWRAQLIGVCTRLRDQFLRYPGISRAAFAAAPSNLDTLRVSEGMLGIVLAGGIAPQVAAWAIDALTLYVNAYCLEVSVAERRRAPDGDWVLTRAEMMRRFAALPDGFPHTKRYAAELTGGTVQDRFAFTLNLIIDGIPG

SEQ ID NO: 14380 - protein, 568 aa, Actinoplanes utahensis
MGLPRAVPADIRPAGSARGVQEYPRTAELGFVTILNRMRLGMRLAAAFATVVVLLLVVMAAALITAARQGAATDRIAQTQKFVALMKDAKFAAADFNGWQTAYAFDALRGVPDAAKDTGSSRKSFLASLGKFQSTVSAAADAATSEPSRTELRRVSALADDFRTADTQIAQLYDQGSTAATRTANGLVIGKEIQIFQQIGEHLDAVVATAGTDFTAAQHSATEAKNIGATVIWAAGVTAALIAVALAVIVTRSVTGPVDQVRRRLMLLADGDLATPVTVTGRDEIADMAGALRQSVTALGDAMRTIDTSATSLAAATEQMTNTSAQIAASAEESAVQAQAVAAATEEVSRNVATVSAGGEQMGASIREIAHSTSEATAVVAAAVQAAQAANTTITTLGQSSREVGEVVRTITAIAEQTNLLALNATIEAARAGELGKGFAVVAGEVKDLAQETARATEDITRRVEAIRTGTDSAVTAIGEIATVIARVNDFQTTIASALEEQTATTAEMNRSVSDTATSTEQIATNVATVAQAAQQTTEGVAQTQEANAELARMSSDLRVLVSRFRYS

SEQ ID NO: 14381 - protein, 685 aa, Actinoplanes utahensis
MDPSPRSVVREECRFVADPPLPAPLLAMLDSDPQGWVLARAVRDEGDIADFAIVYINEAGCRLVGRPRAELAGHRYRELWPETVHDGTLPFYRKVVETGTPATRTVYYDRPSVTGHFELRAGPYGDGLLIRFVDLRQMTVSPGGIRLYDMLDTAFDGFTVLRPVTGPDGPIVDFRCEYVNQLGARLTGRSAEDVIGHLLSEISPESWDDGMFERYRAVADGGEPCRQQLSYPEIGQVWEVKIGRSGLDAVVVSFREITEHIDRQRQLAASVTRAEHAAARARALESVTEALVAASTTTQVYAAVGSVLRPSAGGQGLLVLLRQDRGLRLAYHAGYEPDVVARLRHLPLDHPYPATAVARTGRSRYLTSPAQLRAAQPDPAVAVPPGERQAWAMLPLTVAGDVLGVLVVGYRDGRDFDDDTRSTLTALAGLAAQALQRAMLFETSMSIAAELQHALLPASLPVVPGLRHAARYLPWTRGAEVGGDWYDVIAVRDGRIAVVIGDVAGHNVAAAAAMGQIRDALRAYAVAGLSPSSVMRHTHDLIQSLHLDTIATCCYLQVDVAVGTVTAVLAGHPSPVLRTTNGTGLVTLPIQPPLGSFRRIAYRDTSFDLPPGATLLLYTDGLVEDSRHPIDRGLSQLCAAVRAAPGDDPTAIIDHVLAAGVGPRPRRDDIAVLCLTRDAEQPETR

SEQ ID NO: 14382 - protein, 591 aa, Actinoplanes utahensis
MRRTDRRPGSPKVKAIRLVAAAVTLAASGILTVTFVSGGGKGTADAATSLGQYVPIEQVRPNVARVRTSPGGSAGRFRVDCGTNRNRKFSPDNPVAQPGIRNGAEHVHDFVGNLAITATSSDADLDASGTTCRDGDKSAYFWPVVRIDRSVRDGGAVAQALAGTSPTVVCPPVRDRLPAVPAGAKAAVDRQLAELDRLEADAGRQVLAGRGVNVGLNTTVLQSLRARRAALLTGIGDTMRAAGARRPDGMVSLADCDVSYDGLHAALHGDHRAGSVATPTVRCPGVRDKLPGVPATALDEVDRNLAELDRQISEANQRLVGDPAVGATAVLGPLRAKRAAVLDRIAIAIGRTGPRPAGLEQLAGCTVDAATGGTSSPAPGSGVPSAATGSGAPSPAPGSSALPDPQGPNLELPGNTGGIVRPAKVLIEYRGNATAKVVPMPKFLRALTGDAKPTSRGPANARAAWTCSGFADRLTDRYPICPAGSRVQRVHDFPGCWDGRNLDSANHRSHVAFADRATGACPAGFVAIPQLRVTISYDIPRDVQVNGQYALDSFPEENHNPFSDHDDFINVNAARTMQRIATCINRGRNCA

SEQ ID NO: 14383 - protein, 217 aa, Actinoplanes utahensis
MTSTRLTIDVWADVLCPWCYLGEQRLSEAIGQSPHAAEIDLRVHTFQLDPDAPAEVGTTLAYLAKKFGMPESQARTMEEGMAEKAAADGLTYVVDRPAGSTFDMLRVIQLGNAHGVGWEYLRALQAEVFGGNFDAYEHETLVRVGVAVGVGEAEIRDVLTSDRFAEEVRADHDAAVGLGARGVPFTVLGNRLGVPGAVSTRQYAAAIKQAWAQVDAG

SEQ ID NO: 14384 - protein, 210 aa, Actinoplanes utahensis
MRAACRSPYSAIVSVFPERSAPGSTPPPSSRPGPRSMPAEDGPLRFVLVDDAEYCDAQTGRCAPGEVVTQVDLNELSTSVLPYVSAVAGAYGSAVLDKVKDAAAEDGADATVSWGRKLLSRLFAGKRGEKVSDAVRELAADPADEASLALVRAQILKALTEEPSLATEVRELLQAATPAGDQYQVIITRSQGIQIGSRNTQTNTYPPLGD

SEQ ID NO: 14385 - protein, 121 aa, Actinoplanes utahensis
MAIMVWVDKADWNCCGDPFRVGSRVDWELRRDIDARWLGEVLGSGAAVGVDAYQYHHGGPDAVIEPASATVTRIQAVHARPDPRTGTVPGSGVLTELPEVTRGVPDRGDLTFEGFLVRLEE

SEQ ID NO: 14386 - protein, 446 aa, Actinoplanes utahensis
MSARHAWVDASAGVAGDMLLGALLDAGADPAVVQAAVDAVVPGSVRISASEVTRAGLRAVKAHVEVLVAEPPHRTWAGLRGMLDDSGLVVAVRDRAVAVFARLAEAEARVHGIPAGDVHFHEVGALDSVADVVGVCAALDDLGVTSVSAGEVAVGSGWVRGAHGQLPVPVPAVAQLALGWRVSAGGSGELATPTGMALLRALAATCEELPSMRVEAAGTGAGGRDRAERANVVRVIIGQREEADRAEGMLGEADRAEGKLGEADRAEGKLGEADREKIVLLEANVDDLDPRLWPGVLARLLAAGAADAWLTPILMKKGRPAHVLSALCAPDQVPGLRRHLFEQTSTLGIRESVRHRTVLARHVVRIGEIAVKIGHLDGVIVQAMPEFEDVAAVARREGRPERVVLQEALAAAAAAGLVPGRPSPPTPPAAPGSPRTSDHHDRGRPG

SEQ ID NO: 14387 - protein, 260 aa, Actinoplanes utahensis
MEHPTSTGPGSPLPRDRTRCRTGAWTTPSGTKRWYGWVVTEPLDYADLDLDRAARRGYPEAVFCAGKTSAQVAGIAAAVRSRPEVTTLFTRAEPAHAAAVLGELPDARHYPDAGLLAWPPDPAAPTGGLVVVMAAGTSDLRAAREAELTARHLGRATELVVDVGVAGLHRVLGRLELLRRARVVVVAAGMDGALPSVVAGLIAAPVIGLPTSVGYGAAFGGLAPLLAMLNACAPGVAVVNIDNGYGAGHLAAQIAAEPAA

SEQ ID NO: 14388 - protein, 171 aa, Actinoplanes utahensis
MRSKLSAGAVVALAFLIPAAPAVAHTGAPAGTKTNRSAERKVYRDLREIVTIDPDTATSTQVRLVANRILFESTREALPVLPDAVQAAMDGTEAQLRTFLKTGLPNAWATALRISVVRTLTDAGPHVYAAAQQTLDTAKIDAYLTFLNVDLYTARELDLRVPPRHVPQRQV

SEQ ID NO: 14389 - protein, 35 aa, Actinoplanes utahensis
MFRRAGSAAGHQHDAQTGRDAGVAGGGEPHDLMAR

SEQ ID NO: 14390 - protein, 169 aa, Actinoplanes utahensis
MNASGPAARQAELRLRVAEHLEPGETLHAALWIARDPGLPLISRLAPGMPGSPPPGPAGGIAAELYRHLPEHTVAATLALTGDRLRLLLLDGEFRPPRRRLFGRSEPAPLPPLAPVWECPRAGLATAAADEPAGSLTLRFADGSALAVAAPGFTAVAFAEAAGRSGAGG

SEQ ID NO: 14391 - protein, 626 aa, Actinoplanes utahensis
MGGAISTVGGNGWWARGGDGGAATAAELYHPGGVAVDPAGTMYIADSGNNVVRQVAAGIITTVAGTGVAGGTPADGGLATSGNLSDPEDVTVDSGGVLYIADTGHHRIRRVAGGVITTVAGTGVAGSLMTGVAATTLLSSPYGIDTANGMVYVADTGNNRILMINGAAVSVIAGTGTAGTSPDGTAASLAKLNAPRDVKVDASGDIYVADTGNHLVRKISNGTISTVAGTGALGYAGDGALATAALLDQPDGLESDTAGNLYIADGNPAAAGYGGSVLRRVDRHGVIHTIAGKYQSYSWAGDGGSGTANAARVHTPGRMAIDATGTLYFPSSGELRVRQLTLQTSAAIFWTSNATLGATGAVYGWEFVSRTATPIASITVALPTATTGAGLYVVSAVHLPGTGTVSLSGTTLTYTLASPVTVPVGRHMYLSVAGFTNTGTAGGYGTTITTRAAGAATIDVSQSGAVTFTTATPVLVVPNPATTVTAPAQVVLYVDPITQGDNSVTAALTVKSNATNGYTLKVAGTPMSGTYGALTPVSGGLASPVTGGGFGAGRFGYAVSVSGAGTFAGTAGSYAGYTSAGEVAVTAGRPTAIGGDTVQITNRLKVDFQQRAGVYTGTLNFRVTGL

SEQ ID NO: 14392 - protein, 321 aa, Actinoplanes utahensis
MSFSTSRRLATVAVVTAAAVAGMAVPAYAAGTLTGVGWSTSQPQPGATGVRYTWTFTTATTGTIKHVFLTVPTGTGVPGSITVSDLYGLTTGTATLTGSTVDFVVTSAASVSAGTGVLISLSGFTNTSTAGAYSSVISTQDTAAPTIDTATGNTVTFNDTSTAVTVVVAQSTAFSSNTTGFTMLMDPSVPSLATQTKDVVLTVATNAANGYTLGTRISQQPLGQARGATLPAVAGSVGSPVTAGTDTFGYTVSAHTGVGTVQGSMGGGYAGYTTAGYAVPFAAFGPTNGDTVTLTNQAKIDYLLKADTYGASITYSVTPSY

SEQ ID NO: 14393 - protein, 210 aa, Actinoplanes utahensis
MRNRNRALVAAVITTLTLPFGTPAHAATDAGAAAAAITVEVIAASGSGCAPGTASVVSNGDDTGFRVRYRDFVATAGGDADVVDRRKNCQLGVLVSIPDGWTVAIASANYRGRASLRSGATALQRTSYYWQGSSATARKDVTFSGPYSGLWTTWDVAPVLTYAACGSQSVLNVNTELRLNAGSSTGTSTMSMNTTEGDVDTLFNFSLSPC

SEQ ID NO: 14394 - protein, 216 aa, Actinoplanes utahensis
MKFLLTRGCVALAVLASSLFLVSPASAAIVFTDPPPPDAISIQLVAMAGSGCAPGTADVAISPDNSAFTAIYSAYLAQAGPGVPVTENRKNCQLNVLVNAPSGYTFAIAKVDYRGYGFLQRGAVAQQRANYYFQGMSMGSYANHPIAAPLDDNWIATDEVPIAAQVFRPCGEQRNLNINTELRVTKGTSTDVSYVTMDSTDGSIETIYHFTWMRCH

SEQ ID NO: 14395 - protein, 413 aa, Actinoplanes utahensis
MTGRRDHLTRSAPGCPGRRESRRTAAWATVALLATGPLAACSPAADAQRPAPPATPSPSPSLLPQSPAAAGPILPGMPPPLDPSDVYAADRPGHVAAVAVHDPALVYVPNLGSDTVMVIDPRTYRVIRTVPVGHGPQHVVPSWDLRTLWVNNNAGSTLTPIDAATGRFGKPIRVDDPYNLYFTPDGKFAMVMAETRKAIIFSDPHTMAARHVLPIGCRGVNHADFSADGRYFIATCEFSGELVKVDTAAQRVVGRLQLPGHAMPQDIKISPDGRTWYVADMQTSGLWILDGDHLTVRSFLPTGYGAHGLYPSRDSRHLYIANRGEGSISVLDFHTGRLVSKWKLPGQASPDMGGVSADGRVLWLSGRYNREVYAIDTGSGRLLARIRVGAEPHGLCVWPQPGRYSLGHTGILR

SEQ ID NO: 14396 - protein, 279 aa, Actinoplanes utahensis
MGVPHPWGVPPRWKVSGFSHPVPPTVRCMQRRHALRAAAALTLSAVAGCDATEPAHVAPPAAEGSPQRPATAPSGKPGADLPDEVQHGPRDRSGVALTFHGQGDPRQVTALLDQLRRGAAPVTVLAVGAWLDTQRALGRRILAEGHELGNHTQHHADIKSFTSATAYAEIATCARVIRAVSGSAGRWFRPSQTRFATPTIKAAARRAGYPTCLSYDVDSRDYTDPGTPAIVANTLAAVQKGSIVSLHFGHEQTIAAIAPLLAGLKARGLRPVTVADLLG

SEQ ID NO: 14397 - protein, 31 aa, Actinoplanes utahensis
MISGVLNAYTREDVFFFATQATFSAPRTTQR

SEQ ID NO: 14398 - protein, 547 aa, Actinoplanes utahensis
MPISRLTPGLHRRPTRRRAVLAGGLAAVAAVAGIGLLGGQPFASAEANISFDNGSGMSFVVDARNGNLTSLQHNGTELTAPGRAAGQIESGWKSAAVSSRTFADRSILVTVDEREVGETQYYYARRGDNTIYMATDIRQPQNPGEARFITRLNRSLLTTSPVAARTAGTVAAVEGSDVFKFADGRTASKFYSSQRLITQQPFGASGHGHGAYLVPGTGEMSSGGPFFRDIEVNDTGDAVNITYCMNSGHTQTEPLRLGLQGPYALALTDGPAPARHSLDFLSAYIPGLLSNAQRGGVQGTATGSWNGQRATVALAGPNGQYWSQVKAGRFLIGHIRPGTYTASLYAGELAVGVAKEVTVTAGATTTVALSGNVPAAGTLFQLGAFDGTPAGFRNADKIETMHPSDPRMAPWNVGTFDIASGAANFPMAEFQAVNAPLAIRFPLRAVPAKGVRLRVATTLNFAGGRPAVAIGSYRSPVSASPAPRDLKSRGVTRGTWRGVNTTYVFDIPAAALKEGANTLSLSVVSGSTGTTFLSPNFVFDALALDPA

SEQ ID NO: 14399 - protein, 281 aa, Actinoplanes utahensis
MQTRSLGDVRVSAIGLGGMPMSIEGRPDEDRSIRTIHAALDAGITLIDTADAYHIGADEVGHNESLIARALAAYGGDTSGVLVATKGGHRRPGDGSWTVDGSPDYLKRACEESLKRLGVDAIGLYQFHRPDPKTPYADSIGAIRDLLDAGKIRMAGISNADPKQIREARDILGGRLVSVQNQFSPEFRSSGPELELCTELGIAFLPWSPLGGIRAAGSLGGAFARVAEKHGVSPQRVCLAWHLAKSPVSIPIPGASRPETITDSAAADTLELTPEDLATLP

SEQ ID NO: 14400 - protein, 760 aa, Actinoplanes utahensis
MRGLRAYAWCGWLGVVACIMLLSPPLGEAGREFAYAGVGLGSAMCVLAGIRLRRAARPRAWLLLAAGLSCGGAANAIWAVELSLRSAPPRFSVVDVLYFAMYPLLAAGLAALPERSPEGSRWIGVSEAGIAACTSATLGWLFVYDPYVLDRPEAVVSANAFAYPILDVLLVAVAVRLLVAARRLRPAHVALVAMTLLMIVADASYVVSVVVGGAWSGSPCSSLCWLAAFALPGVAALHPAVSGRGASISVRAGGWHATALQAVLVLIGPAATGYALILDSREGHLTVYDFIVPVAATVVISLLLVVRMGNGQRQLQRHAEKLGTALAEQAALQRSLRHVNEHDALTGLPNRRRLQNLITSGTPYGLLLLDLDGFQNVNDRLGHSAGDDLLRVIADRLGAGLADADVLARTGGDEFAVLVPGAAPATVTARAEALLATLREPVTIHGHVLYVTASIGVRLPEPTADPAHLLDDADLALYAAKAAGKDCAVWYDAGLRDRQTERLRTVERLRGALRNDELAVFYQPIVDLLSSRTVAAEALVRWLPPGEDPIGPDLFIPAAEDSGLIVPLGEWVLRRACADAVDWHRRDGITIAVNVSPRQLHDPEFTAKVRRCLAETGLPAGALTLEITEGILVGGGTQKSQALAHLDALRGDGVRIAIDDFGTGYSSLAYLRDLPIDVLKIDRSLMPSDDTDTRRTALVRAVVDLARGLELTTVAEGVETAFQAGLLVGLGCERGQGYHFARPMPGTAFSPRQEPVPQAG

SEQ ID NO: 14401 - protein, 274 aa, Actinoplanes utahensis
MSRTWFITGTSRGFGREWAEAALDRGDRVAATARDVSSLDDLAAGYGDRILPLALDVTDREAALAALARAAGHFGRLDVIVNNAGYGQFGMIEEISEQEARAQFETNVFGALWITQGALPYLRAAGGGNIIQVSSIGGISAFPNIGIYNASKWALEGFSQALAQEVAAFGIKVTLVEPGAFGTDWGGSSARHATALPEYESVRAQAAEARRGRAGNPGDPEATRSAILKVVDAENPPLRVFFGNAALAIATADYESRLAEWQRWQPVSIEAQGA

SEQ ID NO: 14402 - protein, 45 aa, Actinoplanes utahensis
MDMHLETADFVAPVLAGLAGMLGVYGAEDVLGRLRRRGWCPRRWR

SEQ ID NO: 14403 - protein, 267 aa, Actinoplanes utahensis
MAHRAAVAAVQRSLDGPKTVVVVNPKGGAIKTTTTLMIARTLGIHRGGYVLGWDNNETRGTMGWRANPARHTNTAVDLLRDLDRFADVRSARVGDLDNYVRSQGDAQFDVLASDEDAESSASIDATAFRNLHRTLSRFYRVMVVDTGNNMRASNWEAAVAEADQLVIVSTVREDTAQSAAWMADALNTSGRGALVANAVTVLADPAAVADRALRARLHRHFGQLTRAVVDVPYDPALIGGGPIAYDALSPASHAAWLRATAAIAEGL

SEQ ID NO: 14404 - protein, 132 aa, Actinoplanes utahensis
MDRDTCRSMSRKVRLTARDGAYVVALAVFETNLVREALRVITQLQISPDRMLVQFGFAKAELAELAERLTPAVTTGAELAVTHRELRMIYLVLRQVPEMFGTEEDFHLRLGFYTEQARGLAAALLAAVDRTA

SEQ ID NO: 14405 - protein, 764 aa, Actinoplanes utahensis
MNVARAAINQATAAKSNAELTRSSADASAQEAGIASFQSRIAGRAALNARVSALALADPAASAIDVASAYAPTDNDAAMAVDIANNAMLIGTEQSAQAEQHAVDADAAAQHAAEMAEKAQEQIKPAYQAAQKAAAEAARAVKASKVAIDAAIGAAKEANAAIKAVSSATEAARVAASYAQGAERMAVEAGHDAGVARQAANNARSYANTADKAADNVQKIAKQVDAAAKSGKLVADSMKSVAKEMTTLAQNLTGAVDQVAQLRDAEKRARQTSWIKTWQDQADKFIDKMFDDPSVRDYLKGITQGAIGTLGGVWLAGLCAFGPGGNSPGNTPDSEEACDMLVDGIKQTIQNPGSLIHLEEWKNGEYAKFFGLWTFDIGSLAIGKIGKAAQGIKLLEDGIPAAIAKLLDGELLAGIKTFGTEAMDAALKKLGAIKLGKLIEIAVDFPNKLKFSNIELNLMKIVIDKRGFPAVEDLVKNLPEGKNLIEELENLLEICKRDSFAPETRVLLADGTTRPIRDVRTGDRVLATDPLTGRTAGRTVTDLHLNLDTDLADVSVATGGELRTTQHHPFWAAGSHRWTLAGDLAAGDTLRTPAGGTVPVTGVQRYDGSRWMYNLTVADLHTFYVLAGRTPVLVHNCGEFDDETGGLTDAAMDRLEKAYGNEVAAGVDHMVERMHDGTPSAADHDIPGLGHDPDKIGQYLKGWVGKMTHKDTQTGAKVAFDPSRGGVLIVDVGYRIHAYKYAADVFDTVKNNKGGPRYVPLNVS

SEQ ID NO: 14406 - protein, 734 aa, Actinoplanes utahensis
MPSPARRGPAEQDHHREIGGEVHRVAVPGARRHGRRHGGDTGHGEVEREHPVVHGRPIGPAGTGFRTRRALPPNCTPASPEGGAGHSSTSKYPSCVACLIYGGFMFSDHIRARFLPGRLTTAAVLAVLTVLPQAVSVPAQAAPRPAAAARPLTLSQVVEMERVAEQEREQRLLADGPIDDVELNRMLIQDLADYDADAEVRAAAAAVLLTDDPAEFTAFLDNALPVYRAAADRRQKLADETNRLMVAEWARTGGPILRERAAAALATGNATKIADFVAVGRDAAVAADKQAELSAAQQAALIKARVEQIVAGGGYEVRSAGQMALDSEDPAVIAEFYNTGYKAAAARDTDAQAQIEAALAARTKAAGDLADLASRATQAAQARTTIIRASVSATSSLTVTANSMLLTNRYAKQGDAIYAADLPIRKAGGKTHTADLTRLHTDTCAEAATTARNAGQVTAQADVAATAAQTLVQTGLSHGVAWAEVTQAQKDAGAAAKLAADTACSAAEATEAAAKALDADRNATVEMANAVKYRQAAERNLAEATKLANQAEKLAAAAKAAEAAAHTQRLRAEDEAQQAWAKADEAKEHYERAAAQRDIARNQMAVALQQQTVAMGAAQRAVDQQKIAVAKGTAAKSAADEVNASAKRFEGLASDARTKAADANKWINERNTMELSRTAHAADAIAKKGTAEGDYAAEQVKIIDAQLPGIRDAETRSRQAANSAAAAADAAAVA

SEQ ID NO: 14407 - protein, 205 aa, Actinoplanes utahensis
MPAVTIDEQQLRTAGPVSLAVKVPQITAMFWVIKVLTTGMGETASDFFAKTIDPPVAVGITGLALAAALIVQLRSRRYRTGVYWFAVVMVSVFGTMAADVLHVGLGIPYPVSTVAFSLALVVVLVTWYLSERTLSIHTVTHGRPELFYWATVLVTFALGTAGGDLTATTLRWGYLPSGLVFAAALIVALVGYLGSRRGPAVQAAA

SEQ ID NO: 14408 - protein, 125 aa, Actinoplanes utahensis
MPPGRVFMTALLGSLAILLGGRLFDNVGDAWGTTVLFVLVVLATSALTAELTAQAQRDRGRCGGWARMDTGIVLALIVLAGLLLTASAIGVRSAGTQTAAERFTVLYVLLAGYFGFVRLRTIRGR

SEQ ID NO: 14409 - protein, 249 aa, Actinoplanes utahensis
MTATMTPGQATIDTLHSVLRSEAIQPSFQPVVRLADGEIVAFEALARFREHHFASPDQAFAAANAAGLGVELELLAMQRALASLDGVPGDAYLSTNLSVEAILDPQVQETLLANAHRRLAVELTEHTQVHDYPRLVAVTERFRAAGILIAVDDAGAGFASLSHILQLRPDIIKLDITLTSGIDTDPVRMALARCLAGFATDINAVLVAEGIETAAEHEKLLELGVRFGQGYLLGRPAPLPRIAHSLNAE

SEQ ID NO: 14410 - protein, 59 aa, Actinoplanes utahensis
MNIATHAVRMTKSPLAAAEPARSAVSVRDAWEPLFEILNGAPARDGRGGHRPTVTRHSR

SEQ ID NO: 14411 - protein, 219 aa, Actinoplanes utahensis
MARWNLSCDDSAEHRAVSACHDGGVSASPARLTAARSAGLLLAGAVLGAGLTPVPALADGPGYGGTANALTVAWNAGSEQRGVAVYAVGFRSGSPVQVRVGGEAERSVTADPSGAIDMVLTAATTTATAATVASAAVTTATAAAAGTIVLVSGHTPAGELRTLVGAVPPEAAGIGVAQLVPWAATLVGLGGAALWLRRRYATVAAGQLSRYRHPARHRA

SEQ ID NO: 14412 - protein, 774 aa, Actinoplanes utahensis
MSFAARTLVEAVAGPAAIADEHGRILVANSRWPGPAEGEPLTAGDPGCPAHGRLPELVRAARPGTTTAPACHCGPDSAATVRVTGLESTCGAHRRLITVETAVAVDGRQQFLALLGHEVRTPVTTVVAAIDLLRAQSLPPDVRETVDTVHRAVRNLRDLTDDLLDLARLETGSLVPRVAPTAVRDVLESVLEPLQQEARDRGLLLLAAPAPELPAVVEADADRLRQILAAVVGNAVRFTERGEVVVTARPDGTDHYRLEVADTGPGIAATDQERIFEPFVQAGYSAARRHEGAGLGLPLARRLAACLGGTLTVSSEPGRGSRFAITLPLRPLPGPVPSALPLTGRRIGISAPTSHSRQALSWLVTAGGAEAVPLDLDDLTTGRPGVDTVLWCDDAHDPAAVDRAEMILAALGSTGRALLLSGTDPRTGVVRRPGLLSAPVTLDRLVAALNQQRTGVRGAPVTLPPLPAGRILLAEDNEVNRTVLARMISLLGVDCDTVGDGAAAVRELLGDNRYQLALMDMQMPGMDGLEATRRVRSAGCVVPVVALTATALPEDRARCLAAGMDGYLTKPITLVELRRALAPYLTPTEPAAPSSPAAPTSTPAAPSSPAAPTSTPAAPSSPAAPSSPATPSSPAADGAPVAEPEGAGSPAAPVSEPGAEVLSRAQLSDLEAQLEGRELVAMTVGTFLTELDGRRQAMAGALAESRHDRLGAVAHTLKSSSALLGAQPLADACARVERLAAAAVDIAVLAAAVSEVDRAAGAAAIAMAGYLNES

SEQ ID NO: 14413 - protein, 108 aa, Actinoplanes utahensis
MLYGDQYAGATTLVRTLAVVAGVTSVVTVLTNAALARHSRATWLPWAGVALEVGLIQLWHGSPLAIAACSAAALLPTLLVVAATEIRAWTRRLPAPVEGSHLTEGVPA

SEQ ID NO: 14414 - protein, 297 aa, Actinoplanes utahensis
MQFDSGRGRGFLLRAAGPIALAVAVQSAGNLAFHALVGRLLEPAAYGALGAVLAAMVMLGIPLGALQTAASAHAATHGAGRATTLRSLRAVTLWTLPAGLLTLAGAPLLSGYFHLDGLGEAAQLAPYILVAALLATARGLLLGDRQVSTVAGSYLAATVVRLALGVALTVPFGVAGALTATLFGEVAALVTAARRLTRRPDPGPGVRLRPRAVGGAAVAVTGLFLFSTADLLLARHHLAGTASGAYVAAATVAKTVLALPAAVMSAVFPRLAAAHDRPGRARALRTAVAAVGGPLAS

SEQ ID NO: 14415 - protein, 499 aa, Actinoplanes utahensis
MTDKLLTPLPSRADVLDTLTAVLTDAGLPWAWQGATGAPQRWCAGTGPSDLDVWCAGPGPVAALMSRYPCAVIAAPADPRRLRHTSLAVLTGSGPAIVDVTHGDLRVGPVLLVPAAEVTHDPGSCRLTGAAAVADLLVRPVLRGRIPEVGRLAEARGAWAEADAAHLSALAGRLTRQLGARVTADLIAALRGARPDPGLPRRARLRLAARSLGPGTIGATWAQRHGVLPAGRSAGPLGLRTRGVVVALVGTDGSGKSTVAGALHERLRDHGFATATAYFGMARGNLPGVALARRLLGVGSTAPQTGTAPQDRGTPRTTAERTTAERTTAERTTAERTTAERTTAEPMTAERTTAGPLDHARLRRMAAWFYAGEYGWRYLRTVAPALARRQVVIADRWVYDLRDSPWPGSAAARLAERMLPAPDLLVLPDAPAEVIHRRKPERRLDEQRAQQERFRRLLAERPARRAELVVDTSGEPGAGLAALVAAVIEAAHAPRRRRR

SEQ ID NO: 14416 - protein, 255 aa, Actinoplanes utahensis
MSRPALDSGRRGRSEVSNDPPVTGGAVSKPRALVVEDSPEFMMICRHLLEKEGFEVLAAGDGAEAVERAQKQRPDIAILDLGLPDVDGIEVCRQIRQFTDAYIIMVTGRTDEVDKVVGLSVGADDYVTKPFSPRELAARIQAMRRRPRATTQARREAVREYGELRIDLEVREVSRAGEVLELTKIEFDLLDLLSSAPRRTFTRRKLLEDVWGDNFFGDDHIIDVHVGNLRRKLGESASAPRHIRTLRGVGYRFEP

SEQ ID NO: 14417 - protein, 145 aa, Actinoplanes utahensis
MRYDRHAQCMPTSQLTAPAATLRPAAAVVPGPGRGAVDLTLVLPLSGPAATLRYLIERLAEALYAQCISFELVAVADTDVAELSDLPLARTVHAARLDREASWQAGVSAAEGRWIGFLDVADCAELDAYGFIELLHQARESAVSA

SEQ ID NO: 14418 - protein, 536 aa, Actinoplanes utahensis
MLRRRRADRVAALPAPRRLRQAGRARRADGLLRGQGSRPAGTRGRLPGRPHPQLPLPQRGRPAAVPHAAQETRVRGDRRRVRARASGGVPVAGQHPAPVGSLPAQRPLSADPPAAVRRDVADEDQRVRLRRDRPPPRPGARHGPPGGPRVTRVAHVIAEFSAREAMGRTVTETVRRVPGEHHLITTHVVDGAEVFAGAHELGGPLETFPLGRSAPLSAALAGIRPDLVHLHAGALGPLMALHPALRPYPKVLTVYAWPTLPGPVAWRRSGLAEMWSSNVLRPRVALTTVLPVPLAAAALRRAGVTTVLTPDPRVADRLGRPGGPAIVRYACGAPDDDRRARFDPDHPVIVFAGRAETVRGLDTLLDAFRAVRAEVPGVRLRLLLIPRPELPAILARAGAAGDAIDVVTDPVPDLLGEFAAAQAGAWPFKFDYTTSPPAMALVEAMAVGLPVVGTDVACVRAVLEPGVNGLSVPPADPRALARALIRLLTDEPAWQRYARAGRASARDHMGWDRATALTADAYRSVLGGLADRLTSG

SEQ ID NO: 14419 - protein, 1086 aa, Actinoplanes utahensis
MDRRRLLGAVGVLTTMATSLVATPAAALSALAAPKNLTVARAADDVHQIKVGWIPVTGADHYAIDILAGDVETVLDLPATATGYTIDAPNPCTAYKVRIGAVDAAGTVANTGFWSLRALTPSAVMGMAPTRIDEGTTAVATWREPAWTGYTPLTGYHSVFTRLSDGAVLADQTSTGLSFTYPGIDPSRAYTLAVTTVNQYGACVTAKSLLDRFRPADPTDLVVKRLAEAPGTVSVSWTPPANGPAPTFYQVGYGIDKVTKTLKLDTSVTATTLALATDKAWIVEVKAYNDNGGSSAVSGSVPVFEASGSPPATDATWPSTSTVVDNGPDRTPPSITATLSQKPVNGWFRTPVTIQFTCADDSGTVAVCPAPILANTDGLARRFAGTAKDAAGNTTTTTLTLKVDQKAPSITATVLGTKNAAGWYTTAPTIHYTCADETSTIASCPADTVVSAGKADQKISGIASDKAGNTATATVVLSVDPTTPKITASVTGDVSPAGWYTTAPTVHFSCSDGTSGVVACPADVSVSADGAGQKVSGTVTDRAGNTAATSVTVNVDQAAPGVTTTVSGATANAGGWYRTAPTVHFTCTDETSGVATCPADSTAAADGAGQVLAGTATDRAGNTGSGSVIVNVDGTAPTISAAVLGATANAGGWYHDAPTVHFTCTDTGSGVASCPADIPVGTDGAGQVVTGTALDAAGNTAATSVTVNVDRTAPAITATVLGATANAGGWYHDAPTIHYTCTDTGSGIASCPADTPLTEDGTARTLTGTATDLAGNSATVTTTVSLDRVAPSIGTTISGGTANTNGWYNTAPTITFTCADDRSGVAACGTGTTVGTDGAGQKVTGTVTDRAGNTASTGTTVNLDRVAPQITATVTGSANRAGWYTAAPTVKFTCTDDRSGVVTCPADQVVTDGAAQKIAGTVADRAGNTASTGTTLNVDRQAPVVTIAGATNGAVYGPDAAPVVTCVTADAVSGVAGKATLSDYESYGKHTVICSGAVDKAGNAAPAVQLTYSVKPTIEWLIALTHKDLPRASAVTLKQLDADLMGHRWTAYTARVTALSLGAKPELTVADATTLVYWAVMLPLYY

SEQ ID NO: 14420 - protein, 285 aa, Actinoplanes utahensis
MNRHDERPTVSNNVVSPGTELAELRAELDRERRRNTELERTVAELRTFASDVSHDLKAPLAGICGYAQLLEHLDVGYPRPAEYDEFVTEITRCTVRMRQLIDDVLTYATTQESRLHLAPIDLAALVDDLVADTAELVRPAPQVRRDALPAVRGDHGMLRRLMENLVGNAIKYVPHGEIARVHVAARLLDDDMVRIEVTDHGIGIPDGQHEAIFEELHRAHPDAYPGNGLGLPICRRIVQRLGGAIGADPQFRGGARIWFTLPLATTPGEPPVVAAPELDLSHTPA

SEQ ID NO: 14421 - protein, 619 aa, Actinoplanes utahensis
MGYAARTLVEAIPVAAAILDPDGRVLLANRQWSGGNGELYPAEGGFLTAAPGPCGAHRGVLEAVWRATPGAGAAELCCRCAEDIVHTLRVAPLTGPGGEDQRLVTVVAEQCRDTARSQFLALLSHEVTTPVTTVVAAVDLLRAQQLDQGVREIADDIHYSAKALETLTENLLDLARLETGRLTLTREPVPIRELLEGVVQPLQSQARNKGILLLAAPAPQLPATVAGDPVRLRQVLTALVGNAVKFTASGEVVVLAEPAADGSLLVTVSDTGPGIPEPQQARLFQPFTQADSSAARRHEGAGLGLALAARLVDRMDGAIEVESRPGAGALFRVRLPLPAASPDGDGQPRPLARRRVAVMAPSDRSVRALTWLLASAGAEPVPVTFADVTGALPDVDTVLWCDDAHDPAAVRRADTVIGALGPDGRALMISTTDPRTGIVRRPGVLTAPLVLRRLVAALNRERTGVRGAPVTVPPLPGGRVLLAEDNDINRTVFRRMIELMGVTCDAVPDGAAAVEAVLGGDPYDVVLMDVQMPRTDGLEATRQIRAAGSPTPILALTATDPADLALCLAAGMNGRLSKPITLPELRSALRPYLTPGADPGVDHLITRLQTGDEKSRVMA

SEQ ID NO: 14422 - protein, 195 aa, Actinoplanes utahensis
MGKLDPEAFRYPVGMPHSRCMLKLAAARRIVAAMLILLGACASLLAVAGPAAAAVSSSTDKLVLTWAEGGNQLRVTGFGYRARDLVEVRLGSSPIQQTRGDENGRIEVDVPQSLVGTGASGTSIVLAGRSASGAARVLVSAVPPQATGRGPVEVLPWALGALAAVTLGLGARLRRRSGHPVAAPGGYRGRRRLAV

SEQ ID NO: 14423 - protein, 1317 aa, Actinoplanes utahensis
MSGGVRVARPRRARRADGTGPAPAPLAPAGAGRPAVPARAHRGRRAVRRLWPGACPRPDRSGVLDRAGRARAGRCRGAPGPVRPAARGHRGLIRGPLNRAALLAARPYLIVLAIDVLIVSRWFRTGTFIAGGDMGAFIRRGWAPEMTWSWNHQLTGAGSAGYTMARAFEFLLIWLCRQVGLTEYSAQWLFYTCIYGLVGFGVAYLAGAFVRSGPGIVVAGSFGMLNGFFLTRLPNPLNVISVGSVAFVTGVAMRVAQGRRVPAPIAGFALMPTSFLSFNPPMLVVAYAWAVAGTPALAALLLGRRAAGRLIKWFVAAVPWVIGLNAWWLVPLAQSFVGGGGATANATFTDPTNWSWSQVNNLPPNILTMVANWAWFLPQYLPFAADLDRPWWIWIRYLLPALVFAAPLLAPRRLRRVALGLLAVILVFVFLAKGLRPPLARVNLLLYLHAPGFWLFREPMSKLGQLLVSFFGVMLAIGVAGMPAVVRRVVPRRRPYAYAAAAIPLLLVLAYPFPIYTGGVMPDERPSQPSMHVRVAQQWWDTAARIDADPRPGKVLVLPLDDYYQMPTTWGFFGADSIANLLIKHPVVQPKPEGYFGDVPGFAAHLRLVEAALLAGDLTAVPKLLDAIGASRVIVRHDLVRGLPNRYFADDRLLAAAMTRVPGATLESGGLLDVFRLGDGADPTVRTYDRVLDAPARPEAGAAVLGTVDTRTAIAARRDTSVAAASPQVDDHPAVTPDVVYWPVPAVDEGSPVTTVDVPAGRYTVAQRARAAPALVPRVDGGDLVLADPTVVKVDGRPVSRRPELRVPLPAGRRVLAIRAGTRRTVSVDVAKPAPVPVGAATSLTLLAAAAKPAKVSGFSPVFDCNSYEPRPWRELGLSAKVSDTKQGRTVTLAAADHAACTRLIVSGASPGEIYRVRLEYHRVSGARPQICLWQSGAAGCELSARPSLSDDWIPYEGVVTMDAGGELQIILHADAIRRLGPRTVTEYRGVQVQALEQVGSREVWPPSVPETAVELTAGRHELRVDGGQAGSVLSPFEPLEDCYRYDDQTAEQAGLAAEAQTGVDGETTYTLKAVSHLACIGATAGVLGASALYELSLQARSVAVRNPKFCLFLRGPDLCRKLPSVAVYQGWTRYETFIPPDPDTVETRLYLYGLRDLAGKQQSQVEYKGVRLRPVASASAVVLVRQTAATPASSADWTRHDPAHFAGTLTASGPTMLALAESAAPGWRLTGIPGATKVTLQGWMSGWRLPGGGGFALSYGPARIARYAFYLLPVTVVVAGAYMYGVRLPAGRPGDWTARHRRRRRLPWRLLKWPRR

SEQ ID NO: 14424 - protein, 337 aa, Actinoplanes utahensis
MTALVRRLLGERSRRRMRWARRHTVLCAIGLLVAVLAAVVVSTPASRRLIVGPDTVTVVAVGDMACDPADPDLKRATREQGDRCRQQAVSDIAVALRPDALLALGDVQYEMPTAEAFRTVYGPSFGRLRDRTVPVYGNQEYKVQDASSFTAYFGDRILDKRGYWSQQIGRWHVVVLDSNCSAVPGGCGSGSPQQTWLDADLAATSSRCVLAAWHHPRWSTGIAGPDDRTAELYRTLYRRRVDLVLSGHEADYQRFEPLNPDGVVDPEGVRQFVVGTGGQAHYRPEGTAATGAPPGAYADYDHHGVLALTLRPASYDWAFHPLEAGRVTEDEGSARCH

SEQ ID NO: 14425 - protein, 421 aa, Actinoplanes utahensis
MAGAGRRCRAAGGRPPTARFRRCSVICASIGNPPASRGHIPNVLNPVPSRPISPVMRILILNWRDLSHPASGGAEVYTEQVLRRWAAAGHQVTLFAAAVAGRPADEIRDGYRIVRAGSRFTVYREARRWWQRHGRGRFDVVVDETNTVPFQAHEWVDDGARTIALVHQTCEEIWHINAPPLLAHLGRHRLEPNWLRRLGGSPILAVSESTREALARFGAHDVTVVPEGYEPPHPLPHPAKEDRPTAVFCGRMVNYKRPRDVIRAVLLARAAVPGLRLWMLGGGPLLDRLADEAPDGVEFFGRVSEQDKHDRMARAHVHLAASVREGWGLVVTEAAALGTPTIAYDVPGLRDSTRAAHGIVVPPHPEAMAERLADALPGWVRRAPEPLPYGGAHSWDEVAAALLTAVEREARCPRGPMRVAA

SEQ ID NO: 14426 - protein, 709 aa, Actinoplanes utahensis
MTEQRRNRAVGGRPPAARHRRPAPATRLTLESTLVGLVIGLLVVAPWTRPGYLLLLDWVAGPHTALTPGLYGLDPAALDALPYRLVTHALRAVVGAGATSWLMILAYFPIAAGGVSGIAGGSRWRRHPAAVFACVNPFVVERLHAGHVPFLLSVALLCPLTASALHARRRGGWFAARPAGWYALAISVGAHAAWLGGMVLLAVALLPRPGRRHLARTAVIVVSAGCVYAYAAAVVATAILTVRVSDEDLEVYATYAGASGLTATVATLRGFWRGGSDSSPQLALGVVPGVILVVATVAGLIRLCRRDRAVGAPLAAVTATGLLLGAGITGPLGPVYRIAFDTLPLFHAMREQQKWAALAMIGYAVGFGAAAEAVALRCRAGRPVAPRAVAVGAALALAGMTATVSGSLFWGLGGSVGVSHYPPAWYTADRIMGDGDESMLFLPWHQYQPFTFTAARSVATPAGAFFRRPVLSSDAVELGPVRSNSSSYRMAYLDRLIAAGGGGSFGRLIAPLGVRYVALARDRESGTYAWLDRQPDLEPVLRTAALDLYRVTVSGIGRVVSARDGDYAALLAWAARGRLGTEAVISGAGGGTVPSAASGGLRRVGSTRWRVAAGEAGWVVLPEEWSAGWTAGDQVTRRTVAGTVAVHAGSGAFTVRYAPWKWLRLGLAASLLTLVALLGAGLVEHRRELSPRFRRRPGGSGRRGAGPGS

SEQ ID NO: 14427 - protein, 159 aa, Actinoplanes utahensis
MSIGKGDLAPDFALADQDGTLRRLTDLVADGPLVLFFYPGAMTKGCTAEACHFRDLAAEYRAAGVQRAGISRDPVAKQKLFADTYTFDYPLLSDPESTTIAAYGVKRKLNLGPLSTKRMTFVIGTDRRILDVIHSELDMNQHAADALAVAVAARAQHGS

SEQ ID NO: 14428 - protein, 413 aa, Actinoplanes utahensis
MPRRRSWSLMPASRRRRSARCRSRGADTGAIVARPPGSGRAPMCSPARREHRRWAAAFPSPMTSTFSAKPRLSILDLAPITPGGTVAQAFDNAVALARAAEESGYERVWYAEHHNMARIASSATSLLIGHVAGRTSTIRLGAGGIMLPNHAPLTIAEQFGTLASLHPGRIDLGLGRAPGSDQVTMRAMRRNPMSADSFPQDVLELQGFLGDESRVPGVRATPGAGTHVPLYILGSSMFGARLAAAYGLPYAFASHFSPGLLYEAVAAYRSEFQPSAQLSQPYVIAGVNVIAAPTAESAREQFTITRRIRVRGLISRSTGPAGAPSAAGSTASTDFTDEEIDEFLTTPNGRQIGAMMTYSAVGTPDEVRSYLTSFADRAQADELIVAHQSTQIADRLESVRLTAAAVLGAPLPS

SEQ ID NO: 14429 - protein, 219 aa, Actinoplanes utahensis
MTTYVLVPGFHLGGWAWDAVAGPLRAAGHEVHQVSPRLEPGTTVDDHIAELVALVEKLDDVVLVGHSYGGLVITAVADQGATHVRRLVYVDAGPLPDGMSQADFTGEPVVPVDGMLPVPAEAPPSATGFDWAIVRDRGRPQPAATATGPVRHGEAWRDIPRTAILCSFPAARLREMAANLPAFGLMAGAGWTYRELPGGHWPMFSAPTELAALLAEVGG

SEQ ID NO: 14430 - protein, 171 aa, Actinoplanes utahensis
MWPVPQSLGKVLGLLELLQAAPGGVTVGHLADRLQVDERTVRRYAGQLAGLGIPIEGRRGRHGGYTLAPGYRLPPLMLTDEEALAVLLGLLAARRAGLTVTAEATETATAKIQRVLPHALRARTDALLATLDFTATRAVNPSTPDTGILLTLAAAARDHRPVTFTYTKLAS

SEQ ID NO: 14431 - protein, 98 aa, Actinoplanes utahensis
MPAGFDPAARVAEGLATGAWRHEVSVLLDLDLDEARRRIPPTAATLHRTTHGTRMTARAERLDGMARMLAGLGCPVTVETPDALRAELHRIAARLRDA

SEQ ID NO: 14432 - protein, 391 aa, Actinoplanes utahensis
MIRRVRRSSTVASSSSPDRDAPAAVLARTTANSSASSVSGAKSNLTPHSGGPSVRGVANLAHDGGAIVKLSPQSAGLAAAVLSAASFGTSGAFIKPLLEAGWSPAAAVTARALAGGLLLLPLVLFSLRGNWAAVWRGRGRIAAMGVVAVAFTQLTYFAAIRRVPVSTALLIEYLAPLLLVLGAWATTRRLPRPAVLLGSVLAIGGLVLVIGPGALQAVDPAGLLLALGAAVGCAVYFVVAARPADGLPPVALAGLGLLLGGVILGVVGATGVVPMAVATGPVALLGTSTPWWLPLGVVALFGTAIAYGAGIFGGSRLGSRLASFVGLLEVVFASILAWIVVGERLTPLQMLGGVLILAGIAAIPAEPAVPVVAADRAGVSGPKVARSGAPR

SEQ ID NO: 14433 - protein, 243 aa, Actinoplanes utahensis
MTTAQPEPAVPGADRQVARLQPAGSSFGGFGFAHAEPEVLHDVMAEINKFLMVYKFGLAEIGTKINILAEELAHRGRGNPIEHVTPRLKTMASITAKARRIECPLTVDDLRARIRDIAGIRIVCGFVPDVYTVARMLTRQPDVHLVTTKDYIAQPKANGYRSLHLIVEIPVFLSDQVVAVPVEVQLRTVAMDFWASLEHKIYYKHDADVPAALRAELAAAAEDAARLDQRMERLHQEIHGPRH

SEQ ID NO: 14434 - protein, 266 aa, Actinoplanes utahensis
MPALRRDPPWSAESQVLRQIRKKVRHAVVMTVRRCAASTICSAVAVLAAGSPAAASGPPALAGDPYHGKCGRDSYGVNTTVITDHGHLHLTDPATGNEIGDAYFFYTPSCHGFFVTSLTRGDRYYTRSTVWARDRTGPVAGFSSLYPGNGIAWTYVLGNMAGHAACAEIAVTTPHGRPVTTIDLGCTAVIQDHRTVGVPVWALPPGRSDAPESFSARTLAEGARGSRRCSAGSAGTPVSCLRSGSRVTSRSERGQCRPGHRRSRRG

SEQ ID NO: 14435 - protein, 888 aa, Actinoplanes utahensis
MDSGVDGCRPVRAGGPARHYGSAMDADGSRPEVRRARPVERVALPPGPIRDLREMLYRLYAEADCPRIDRLAEAILADDALPGSPRKDLIIKIISGDGLASQQDTVTVAVTLAREAGRDDTAPVAEQVRQLWITARTAPARSDDSVVRVGRVPRPAAWFQDRYAHHALLRAARAGRSVVLTQVLSGLGGVGKTQLAAQFARSLDAAGELDVLAWITAANRQALVAGYADTAHALRLCGPETEPTAAADRLLSWLEHTSRRCLIVLDNLDSPADATGLWPPDNPRGRTLVTTRRRDAILHTDNRTMVPVGLFTPPEAADYLTQATGTTEPRSAVDSLAADLGLLPLALAQAAAYIRDHGIDCATYRQRLREHGLTARLLPPDDGLPDDHRTIVAAIWDVSITAADNHRPRGLARPLLEVAALLDPNGIPDALFTTTAITAHLGRAGITAPDPPAIIDGLHNLHRLHLITHDVDTHAVGIHALVQHATRDRCTPARLAPLARAAADALLEIWPGVDRDPVHTQTLHANTTALRTATGDALFTPQVHRLLFQAARRLGNTGQVAAAVIAAEQLLTSCLRILGPDHPDTLASRHNLAWWRGEAGDRAGAATAYEQLLTDQLRILGPDHPGTLATRHNLAWRRGEAGDPHAAERLLADPSPVLGAPTAAGPRSLAWRRGEGGDPVGAVTAYEQLLADRLRVLGPDHPDTLITRHGLAWWRGEAGDPAGAVTAYEELLSDRLRVLGPDHLDTLATRHNLAQWRGEAGDPVGAAAATEHLLTDQLRVVGPDHPHALASRYNLAQWRGESGDPAGAVTAYEQLLADQLRVLGPDHPDTLITRYHLAHWRGEAGDPIGAAAATEHLLADQLRVLGPDHPHTLATRHRLARWRDRRPD

SEQ ID NO: 14436 - protein, 232 aa, Actinoplanes utahensis
MTAEPVPAGGDARRLLDDVKSLAHQVRVHQRLTWIALLILGLVTMVSIPFDYYGMIVHCVASGDGQACRFERRGMLLYWPPALLLAYAAIAVSYVRAARERGLGARVMPYVVTGVALVVAFLTSWVLFRVYLNGHPLPDPPHPMPWALLFLDRLISPWGTIGIALLVLARLERNLPLLGFTLVYLAVTLIPIDFGWHMNSDTRTVWIPQQVIDGMLLLLGSAGFAWVARRQR

SEQ ID NO: 14437 - protein, 115 aa, Actinoplanes utahensis
MGRPEAAVTAAAETPEHPVNGLDDIVHQRVRLGILTIAHEARRVEFGYLRAQLQLTAGNLSQHLGVLETAGLVDVEKGYEGKRGRTWVTLTAAGSAALAAEIGRLKQLIARVEQR

SEQ ID NO: 14438 - protein, 317 aa, Actinoplanes utahensis
MTTRRSLLTALAAAPFPGDVPRFPRLTLPAPTGPLPIGTVALHLVDPAGGREMMAGVWYPARDIRRYPVFPWMSDPAWRALLRLVDLEAPVRAPLTATRRGAPVLGERLPVILYSHGNDSCRAETTITVQELASHGYAVVTVDHTGNGVSEFPDGRITLPTDDDFTPWDVPAGGPGDRSGHTVGIGVGIANRLDVRRDRHRPGPRATTAPSSSDDDATSHAARRPEKLRPHRREDRFHAARRPPVSRLGRRCRRRPGAAQLGAEPDVRHVDRRCPVEPGRRVGAAERDRRRHRGPLRRGVAALEAVLLTRGVRPIAE

SEQ ID NO: 14439 - protein, 165 aa, Actinoplanes utahensis
MRKIAGSAAAITVLLAGTPANATPIDPYYTLINANSGKCLSIGASNTTSGAAAIQWSCWGGDDQRWYLRKSTAGTVRLVNVNSGKCLAIGASNMSDGATAIQWDCINIDDQRWYLRDAQGAKKLVARHSRKCLSVGASSTADGATAIQWRCGDGDDQRWYMNYHA

SEQ ID NO: 14440 - protein, 707 aa, Actinoplanes utahensis
MDAAGCRQPRGRPTSGRPGTVVRPSPRLYDRHRVPSKRGNVLRRLLSMVGVTAAVLSTVVGVRLAVTQQPPPRPAVQAAATAPDGLGYQRETVRMLTWNICGEAGGSRGSSSYCPWRSRPQAKAAAIETIIRERDLNVVMLEEVCYPDEAAGRGGDRNDLSPLMAALGSGWTYRTAVVARPDGRSDCRGGDLVGTIGEVIAVRGTITSSTVTPLLVAGDPSYYPDADEKRTSNLLCVRVDGWQNTPCVTHLLHTTDPEYARETASLKQKIAAVALPVLGGDFNTMQGSAATSPIRPLFDTYPECDQQAYSPGDAVNEMTHFNSEDAAPTVSRQKLDYVFATSGFAYCDSLTEFADTDANVAAADDPAGLSDHAPLVAFTRGQSLTWKFDETSGAATADGSINGLSGTLSDDVTRSAERVHSLRFAGSGTVTSGVDGTVNKFDTRRALTVSVWAKPDAATAAGSLLNQADNNGRPIDLSYTGGRWRFAMVTADAEGAASDQVTAPAQTGVWTHLAATYDAVAGTMGLYVNGTLAGTATHTRRVPSGTPITVGDGYRGGLDDLQLFPYALSSTEITKLRAAQTMLPAVPTGTVTVPATGTGDPGCHQNGGYGKVPSLTPRLTAVVKDDDPTAAVRADFSLWDNTDPHQPQPIYLGGPGSASDFVTGTGTVSVPVPALLDGHSYGWYVRASDGTNVSATAPVCHFVATSS

SEQ ID NO: 14441 - protein, 983 aa, Actinoplanes utahensis
MALDGDRIDGVTAERRCPDARMSAAPVAADIRRRPWCSAALGKTLAGRWRSPPRLRLVDFQLLGAVRAVHNGQTVPLGRKQERCALAVLALDAGRPVPVARIADLLWHGDPPHRARGAIQAMISHLRAAFRAVDPEHHYIVGGEAGYLLDVAPQAVDINRFTALVSRGRATDVTETRADILAQAMALWRGPLLGDIADDVLRARLSPDIDELHLQAREDWLAARLELGDHDEVTARLKRLVDEHPLRERARRLLMLSLYRGGRRQEALAVYRDTRTVFVEELGLEPGPEMQHLHRTVLSAEAATPGLTVADAPVAPAELPADLATFVGREPQVAQLDEVLTAVGRPSAPAVIATISGSGGVGKTSLAVHWAQRVRPHFPDGQLFVNLRGFDASAAPMSVEDALRGLLHSLGMRPDRIPPATDRQAALYRSLLAGKRMLVVLDNARDAEQVRPLLPGAPGCLVIVTSRNQLPGLVATDGATPVALGLLGHAEGRRLLRRRLGGDRIDADTGALDRIVDRCAGLPLALAVVAARMSQSRRLTLGDLAAELAESRTALDTLGTGDRASDLRSVFAWSYQALSRPAARLFRLLGLHPGPDVSVHAAAALADLPIGQARRILAELTRANLLSEPTYGRFAAHDLLWAYAVGLAESGEPPQERRAARLRLLEHYAAMTLHAAELLLPGRVGSIPLVAPQRTAAEQVDDLKDAVAWFTAESPVLLRLVPAALSTGHHRQAWLLAWGLRDYLDHRRQWDLQITVQQAGLAAAVHLGDWTAQAHAHRNLGRAFTEQGRIDDARHAYRQAFTAFAAARDHHGQASVHMSMGLLAQRHRQPHQSLHHYLAALKAFEQIGDPSGQANAMNNVASGYLELDQHDQALEYGLRALDLAHTTSAWAQAAILNTVGSIWRRHGKHHRAVECYSRCVALIRSVGDRFHEAVALCDLADACAAAGDETSAAQARTQALEIVGHLSESDAAVIRTRLNGGSP

SEQ ID NO: 14442 - protein, 33 aa, Actinoplanes utahensis
MGAIKPWHLFLCLIVVLLIAGVVVAVVSAGRRK

SEQ ID NO: 14443 - protein, 543 aa, Actinoplanes utahensis
MRSSRLGHDDAVIKSWWRDRKSVPAPADPPAADPVRAAVAEAARGGWEPVGHLTTLLAEVAATGDRESGCAALAVLAGWPRVVVRLDENARRAWWRQPLPASPAERVVTRAIAGAYEAPLAVALASTHGDGRVRERAVTAMLATPSVELMPLLVLRTGDWVRSVRDRARAGLALLLADDPARYLGAVLPVTTAIDQRCRGAFVVTQVKAAFSAASPTDRRLLMASSPLASRRFACHLALDGGLLSPPELLDLAESGPDAPVRARAAEAACRDAVWRRRLTALHRLARSRRPEVRSLALTGLIRTGNDADVASHLADPAPLARALARDAARRAGVDAVAWYRSAVLDAPTPPAIAGFAEAAPARESALLHPLLNHPEAKIRAAAVRALRQLDATEAARVIPLLHDPSAQVIREAVVALRPIVKLVDADLLWQLLTDAGTAQRRGGYRLLTAGTVATCLRAGLIAAADPDPKLAARARADVTRLARDATASAWRAGATPELVITTRERTELTALLHHAAPALRPDTVDRLATWLHTTPTTEALTR

SEQ ID NO: 14444 - protein, 79 aa, Actinoplanes utahensis
MAPPSGPVRAAATDGAAGARIRLARREAGLTQQGLSAEVKVSRQTIIAMETGDYAPSVYLAIKIAQALGVTVEALWGDT

SEQ ID NO: 14445 - protein, 167 aa, Actinoplanes utahensis
MTASLVDRVVRWNLDIDGQLYGDERERYRSYEGIVTAATLHSILIPWAAGIMVWPLGRPAVLPLAVVLFLLWAPMVLCSAYVARRKAGVDPRGWSAKRTLIATLSVTPYAVFVVGAMYAFDPAGDAWIGAIVGSGFGAMLCLLMLGRARRRQALAAAEALAADEDED

SEQ ID NO: 14446 - protein, 266 aa, Actinoplanes utahensis
MVDTDALLAAYDAHMRFPTGAVPAGMRHEYDGVLLRIVGGHVGRIRAPRDVGVTGAGLDRLIARQRDYFRARGEGVEWKVRSHDRPADLPERLVAAGFVAGEPASVLIGSAEEMAGDPVLPDGVVLRRISAAGDLRRMAELQSEVLGEDCSWVAAHLAARVSADPDQLTILAAEAGGRFVCTALVEYCPGTDFGALLGGATLPDWQGRGLYRAMIAARAREAVARGFRLLHVDASAASAPILRRCGFHEIAVSRHYQWTPEHPEAS

SEQ ID NO: 14447 - protein, 161 aa, Actinoplanes utahensis
MDEASWYGPPRDVLGRTVPVQQFVVRTGHVVVAVPHLVAFREGCLIVLLVTVRRGGLPMAAWDNRLGGHRAGMPDPEGLTCEIHLRGGTSEPSRLVEAGAESSSDDREYRGELRFWLRPLPPPAPFDLVVAGPGMGVDRSVVTLDGGAVVRAAARAAPFWT

SEQ ID NO: 14448 - protein, 151 aa, Actinoplanes utahensis
MPVTVTTRIAAAPEAVWDLVADITRMGQWSPETTRCRWLTEPPGPRVGARFTGANAHRGRRWRTVCTVVAADRGREFSFDVVGAGFLAVARWTYTFRPVDGGCEVTETYTDRRGPALKLFGIAALGITDRDAHNRRTMTETLARLRAAAQA

SEQ ID NO: 14449 - protein, 538 aa, Actinoplanes utahensis
MTETVDRPLAGVREAIEQGRTALGIELGSTRIKAVLTGPGHAAIATGSHDWENQFVDRTWTYSLEAVWAGLQDCFAALARDVRERHGVELRTTGALGVSAMMHGYLAFDADGELLTPFRTWRNTDTGDAAEALSELFSYNIPHRWSIAHLYQSVLNGAEHIGRLAHFTTLAGYVHWKLTGEKVLGVGDASGMFPIDTTTGGYDARMLEQFDTLAAGRGLPLPLRDLLPAVLPAGERAGTLTEAGARLLDPTGALQPGIPLCPPEGDAGTGMVATNSVARRTGNVSAGTSIFAMIVLESPLSRVHPEIDLVTTPAGDLVAMVHCNNGASELDAWAGLFTEFAAALGVPADSGKVFETLFRAALKGAPDGGGLMAFNNLSGEPITRLHEGRPLFLREPGSSLTLATFMRTQLYAALATLRIGMDVLQKAEAVQLDRMFAHGGLFKTEGVAQNLLAAAIDTPVSVGDLAGEGGAWGIAILAAFLTGRADGQTLDDYLATAVFADARLDTATPDPADVAGFDAFLRRYVAALPIQQAAVEHS

SEQ ID NO: 14450 - protein, 636 aa, Actinoplanes utahensis
MLSIRSGRSMGVGALVAGLTTTMVFCATPTVPVLAAGSAATAAASAVDDHTNVATDEDKVKAAAAIGVNPGIDLLVLDDQGFVFAIYQRAEAGPYVKAEALRTYLSSDPHAAYDFIVRGIFVAAGDDAQAKIAETAARARRSSVAVTVGLDSSDIALIEKNDRDFIFAVWQRVTAGSHVWTAAQTAIADGTGQAEWDAFLNTGAAAAAEQDLRDVIIDGDEAQAAKLRAARLVTAKKALLQLLLLPVTDEVVNAPDRQYVLFVHNNAKGTEVLLASQAALNAPDDKLAQALTDFIFTGGAAANKRDEDAAAAKELAGYRDRVTAIRDAAKADGFQPNLVDAANRALTDGTLLTLQTFLLKGQDEPRATDEQWRATFFKDFNGDRKADLAGITSGGNLFLYTGSGAGKLTAGGAMWATDGSWGRIKAIAAADFNGDRKTDVAAINSVGNLVLYAGNGAGKLTNAGAMWAADGSWGNFKAIAAGDFNGDRKTDIAGISGGGNLILYAGDGAGKLTNAGAMWATDGSWGRIKAIAAGDFNGDRKTDLAAINSVGNLVLYAGDGAGKLTNAGAMWAADGSWGNIKAISAGDYNGGGAVDLAAINSAGNLVLYAGNGAGKLTNAGAMWATDGSWGGMKAIS

SEQ ID NO: 14451 - protein, 161 aa, Actinoplanes utahensis
MLRREIPVTAVLACLAAFAGTRPAYAGNEMMVERCSGDVYISSAYNDRFPPAGGIYLKRSGEAFTPWSPPMPVAGHTFIRWWCHSTTGNWLDPGTWRIDGVNAHVDCDYDSCSLGTGATRFYTFDVNGWTAERSRCGDPATAAISARLGPQRLLLIECRPY

SEQ ID NO: 14452 - protein, 283 aa, Actinoplanes utahensis
MDNRSEVRDFLTSRRAKISPERAGIPGGGQRRVPGLRRSEVAALAGMSVEYYAKLERGQLAGVSAGVLEAISRALQLDDAERVHLLRLAQAANGSSRLVRPQRRPKAWVVRPSLQWSIDAITVPATVANGRQDVLAANHLGRAMFSDLFADPVSPPNFGRFIFLDSAARRFYPDWDLAADMLVANLRTAAGKDPHDGELHELVGELSTRSDEFRRRWGAHNVRTHGTGVKQFRHHIVGDLSLAYESLDLRAEPDLTLTVYSAEPGSTTAHALTLLASWAATYV

SEQ ID NO: 14453 - protein, 355 aa, Actinoplanes utahensis
MNSTPEGIILTVNAIAATSATDPLVRTTVERRDLGPRDVLIEIRYAGICHSDIHTVRGEWGDVAYPLTVGHEIVGRVAEVGAEVSRHRVDDRVGVGCMVNSCRECDNCKAGQEQYCTGGNVGTYASVDRDGTITQGGYSTHVVVDEDFVLRVPESIPYEAAAPLLCAGITTYSPLSHWKAGPGKRVAVVGMGGLGHMAVKIAAAMGAEVTVLSQTLSKKDDGLRYGAQHYYATSDPATFETLSGTFDLIINTVSAPIDMGAHLRLLRLDGTLVSVGAPPEPLPVPVFSLFGARRSFAGSSIGGIAETQEMLDFCAERGIAPEIELIGADQVNEAYERVLKSDVRYRFVIDVDTLR

SEQ ID NO: 14454 - protein, 399 aa, Actinoplanes utahensis
MTQRIASSTSPLFEKAEPSAYFSDDDYRRFHERAAGYDRDNRFFTEDFEDLRARGYLRAAIPAALGGGGLGFAALAREQRRLAYWAPATALAVTMHLYWTGPATAVTAAGVEDLGWLLRDVADGKVLAAGHGERGNDLGLDDATTLAVPQEDGSWLVTGRKTFTSLSPVWDKLGIHARDDSDPEHPRIVHLFVDRDAPGVRTERTWDALGVRATASDDTILENVRVPAAQFVGAHAIGQPYPPYILGILQWYLPLVANVYFGIARRALDLAELSAQERGSLALPGQRHADKPAVQRQLGQAEILLDAAWALLEQTTADLDAGVDHGDWWTSRLFAAKEFTTGTARQVVDIAVQVAGASAVSRTNELERLYRDVRTGTLHPPNSDAILDVVGRTAVGSLP

SEQ ID NO: 14455 - protein, 443 aa, Actinoplanes utahensis
MSVLDAIGDTPLIRLTRITAGLTAEVHLKAEFLNPGGSVKDRAALAMVRAAEASGELRPGGVIVEGTSGNTGVGLAMIAAQRGYRAVVVVPDKSSAEKIATLRAYGAEVVITIGGVTREDPRHVSQVAARLAEQTPGGWLAGQYDNPANPGAHLATTGPEIWRQTGGRITHFVAGVGTGGTISGAGAYLRSAGPVTVIGADPENSVYGGGDGSPYYVESIGHYVHPDTVEDVWPQSYHRQVVHRIERISDRESIETTRRLAREEGILAGASTGTAVAAALRVARDLGPDDLVVVLAPDSGRAYLSKYFDDGWLRRAGFPAPTAPGPLAGGLPLAVPLHLPADSRVRDLGSAPVALLVLPRPGQTTPHPSPGDVLGVVPAVAVAGAAPDAPLAAFAQPLPTVGAGEPVAEAIGRTPPEAGWLAVLTDGRITGLTPRPVPAPATT

SEQ ID NO: 14456 - protein, 253 aa, Actinoplanes utahensis
MGRPARPRRTAARRGRWPDRHPVLGRAAAHAHHPQRRVRRPAGRRIREGLLHQGRARRRAEEGRHRRGHHRGGRLRQVRRLQRHLLQLPGPDLQRHPGQAQRRPAPRLPRPLRPQRRLGGLGRPAQGPEDRVSNLQGSATYFFSLDLLATSAALLEVQDAAILVVATPAARGAYSGALKVLLDHLPANALAGVVAVPVVAAEAQTQADAAEAVLARLLSELGADVVDFGLTAVGPELTEPASVAATYAAAIIG

SEQ ID NO: 14457 - protein, 192 aa, Actinoplanes utahensis
MTTTVRRRTDDQQFRLQLESNAIWNRMVTPGDRLPDMPLLEVDLGPIHLNRLRDTGPVVLLFFRHASSPECDAALHTYRDALVPALTPLDAHLVAVSPQEPGRLEAVKRRHELDFFVTADPRHTLIDAFNIGFRSPDAQPILGTGRSVLPFAATVVADRTGVIRFAEINADWSTPTAPHRIIEALRPPLTTR

SEQ ID NO: 14458 - protein, 338 aa, Actinoplanes utahensis
MSDRLEAHYRRLMWAYPRDYRERHGVEVITTLLDMAADERHRPSPGQALHLILCGLRQRFRLPARRPLALAGALLAAVIVGGFGGVAGTWLGWRTAAGIPAEAALRSLNTAMIGTSTPAEVHPEESAMKGPGVALITHGGRDYSPGRIRAALTAAGWRTTAYREFPVGEHEHLFTFAATRGRLKLDGSGLVVDSAEGAFQNSYRTDVWPVEPAVVRPLTVAGMAGGAVVGWLVAAALAYRVRRGTRARRLLASGSSAVALSAAAVPAFVHGCATCQVLVYAEGSPVPYITYGPGDGIPAWPGTIVALIALAAALGVTWRRRGAAASVAGPAGMEEAAG

SEQ ID NO: 14459 - protein, 379 aa, Actinoplanes utahensis
MRIDFARSVRSRLGIEWEIACVDRRSGELAAAAPELLAKVGGAAGFPHVTGELLTNTVEVVSAPHHRVARAVDDLDRLVEQLAGVAEPMGVDLISSGTHPFSQWFRQRVTPGKPRYDTLIDRTQWWGRQMMIWGVHVHVAVEDRRKVLPIVDGLLTYLPHFQAFSASSPFWAGETTGYASNRALMFQQLPTAGLPPQLADWAAYEALVADLRHTGVIEELNELRWDIRPAPRWGTIEVRTFDGMPTLREIGALAALTQCLVEFFSRELDAGRTVPRLQPWFVRENKWRAARYGMEAIVIRTAAGDERLVTEDLVGELLPRLAPVAESLGCVAELAGLAEIVEHGASYQRQLRVAAANAGSLKAVVSSLVRELRDNLLHQ

SEQ ID NO: 14460 - protein, 98 aa, Actinoplanes utahensis
MAYAYTAVTAESEVAALTGDLIRFDTTNASDDGGPGTERPAAEYVAEKLAEVGYEVTYVESGARGRGNVIARLTGSDQQRGALLVHGHLDVVPADAAE

SEQ ID NO: 14461 - protein, 229 aa, Actinoplanes utahensis
MGPRRGRHEGQPRGQPGRRPPAQTGERDAAAGSRLRLCRRRGGRRLPRRPLAGRASPGAVRRGDRGDQRGRRLLGDRRGRRPGVPGGDRREGGRVDPAAGPRDGRARLAAARRQRGGEAGRRAVLGPGIDVRWDSLPGVETDFRGTLVDAMAAAIGAEDPGARLLPYMLSASTDAKSFQRLGIRHFGFAPLRLPPELDFTALFHGVDERVPVAALTFGTRVLDRLLRNS

SEQ ID NO: 14462 - protein, 232 aa, Actinoplanes utahensis
MPKNSHVLDQASWASLTGPHAHFAQGDGRALRYPAEVSGITAAPPVQDDRVWADLAALVGPAGVARLSCDIAPPPAGWTVEYRGEGGQLVATDALRSERAPEVVTLGADDVPEMLDLVARTRPGPFEPGTHRLGVYLGIRRGGRLVAMAGERVHPPGWTEISAVCTDPRHRGQGLAGVLVRAVAHGIRERGETPMLHASGGNVDAIRLYLSLGFALRRTRQFTVLRAPRDAG

SEQ ID NO: 14463 - protein, 492 aa, Actinoplanes utahensis
MWSHHRPTAAAVIVVAGCAAAAAVMVTENDPRRALVAYLGLAVVNAAAVMVVRFRSHAGFELKELVAGAILAVLLPGLVSLATRAWQARWDVGKDKTILYILVGSAALICYVGKPAYRMMAAAERSANPRAGVSLMVLPIALFCAFLLTGTAVLLLLGTRIGFEPAHSGAPPSATYARTYVFVACALVALVAVSAARLSQPTATCSDAWKPNPAALALMSMAVVSVIVAVACETAVARTPVAWPLRLYFFVLSAVIGLLYGEEVVSTPVRLHVLRPEWPSWVLGSACGAMMGSSCYWLACYRMWTSGGHLADISSAVGALGVLWLVFVVAAAVVYVFAFASDPSHQQLTAKSAASNTFQGQALYAGLVTVVLFVPSQIGGRLGGDMLADLPAIASFCGFAALLWGVYSFTTKRNGEHLASEMTRTIPQAGMRTGTAAEAAELTAKFRQRLAEHLNWQNHLGRAILILSLVGIGAAVHRVKEEVAAEAGLDTT

SEQ ID NO: 14464 - protein, 217 aa, Actinoplanes utahensis
MRPEVRRAAVVAAGTFLAGFGAMYGFHLCADGPHELRGLFTYESATWGDAVLLPTMAACLSLSLSGLAAARHERAIAGMGAVFGFSIGVASQVGWLMDPHPALNWTLPRPHHFTAAGWYHAAFLSGAAAAFAGASALALTRAIRSPAVAPSVRRSLISAGAATVAFAGLVLYDNVATRSTAASRFTGAAGLAGAAGLAVLALVSMRRSGNRTGNARG

SEQ ID NO: 14465 - protein, 97 aa, Actinoplanes utahensis
MAKGYWVSAYRTIADPAKLAAYNQLAGPAVRAAGGRTLVRGGRVAAHDDGVAERTVLVEFDSYEQAVAAHESAAYQEALAALADGVERDFRIVEGLD

SEQ ID NO: 14466 - protein, 317 aa, Actinoplanes utahensis
MSDQSAQPVLPTRKRSRWPWIAAAAVVVVAAGVVVGIVATKDDSADATTGGTKAQTVRIGVADASAPYWKTYTDLAKQKLNVTVELVNFNDYSQPNPALKQKQLELNQFQHIQYLANYNVTAKDDLQPIGATAVYPLPLYSLKFTKPADFPADAKVAIPNDAINQARGLLVLQAAGLVTLKNGGSAFSSTADVESKKVDVVTLDASQTAGALQSGSVVGAIVNNNYATSAKLPRTNAIFQDDPASDSAAPYVNIFTARAADKDNPTYLKLAELYHDPSVEKGVQEANGGVAVLRTVPAADLQALLKKVQDQAVAAGK

SEQ ID NO: 14467 - protein, 337 aa, Actinoplanes utahensis
MTYVRLQHVTKTFTRGRRGPRVAALDDVSLEVAKGEVFGVIGHSGAGKSTLIRLINGLETPTSGQVWVGDHDIAALSEKDRRGVRREIGMIFQQFNLFRSRTVAGNVAYPLKVAGVEKAERDRRVARLLDFVGLLDRAHDHPEQLSGGQKQRVGIARALATDPALLLADEATSALDPKTTAEVLDLLRRVNKELGVTIVLITHEMDVIRAVADRVAVMDAGRIAESGPVYDVFAEPASTTAADFVHDALRDRPSERTLERLRRTHRGRIVTVAVRDRTALSRVFLDRQVAAELIFGGISELQERAVGSLTFELTGSADGIDGALADLRAAGVSVEEH

SEQ ID NO: 14468 - protein, 219 aa, Actinoplanes utahensis
MDEFLTNLPVFREAIGQTFYIVSISVVAGGLLGLALGLILYATRPGSLLANRAVFLIVNILVNIVRPIPFVIFLTAIQPLMLATIGTTIGTDAVTFALSLAAAFAVSRIIEQNLLAVEPGVIEAARAAGARPISILLTVVVPEALGPVILGYTFIFVGVVDMSAQAGLFGGGGLGDFAVTYGSQRYNWPVVYITVATIIVIVQAGQFLGNFLARRALRR

SEQ ID NO: 14469 - protein, 526 aa, Actinoplanes utahensis
MTTEGPAAWAPLRIAAFRALWLALLASNIGTWMQTVGAQWLLVEHSGSDTLVAVVQTASTLPIVLLALPSGALADTFDRRRLLIFVQIFLAAVGVLLTVLTQAGRMPPSLLLTLTFALGAGQAMTAPAWQAVIPEMVPRSQLASASALGAISMNLARAVGPAVAGVLIAQTGTAVVFGLNTLSYAVFALVLVRWRPAAPDPAAVPEPFGAAMRSGSRYVRHSPVVRRILLRASLFLVPGSALWALLPLVAERRLGLGSGGYGVLLAAVGAGAVVGALLLPRMRARWSMNRLLLIAGVVFTAILAVLGLARSEILVIIVLVPAGIAWVMVLSNVNAAMQLFLPNWVRARGLAVYQMVFAGAQAVGALAWGALSDVTGLPATLVASAVLMLAGVATLGRWPMRDTSGLNRDPAVYWPEPHLELDPDEHDGPVLVMAGYPISPDRETEFVSAMHDVRRSRLRTGAERWGLFRDGERPGRFVEVYLVPSWDEHLRQHSGRLTGTDQAIEERALALADGPPEVSHLLSEDV

SEQ ID NO: 14470 - protein, 226 aa, Actinoplanes utahensis
MINSQPLPAERVLEIAAPMLNEVGGNWRLAEGPMLRSGSMGVRLLPADNADPRHLDLEILLNADRPDVPTITDCTLGLAADPVEGARQAIGAWIATTVVTVLEMVEQQGRLATHIAADEEGAFPGWHTIVGGITGWSVDDSPVKQQWIADEMPWSALAPIIAPALDRPHLNGIRLLIGQGGDFTECEVRINGRRHEPAEAALAALDWPRTEQFGLARTFLLLVGQH

SEQ ID NO: 14471 - protein, 56 aa, Actinoplanes utahensis
MLIWAGHLRQHSGRLTGTDQAIVERALALLVRRATDNGTRPAARAIAERGFGSGDW

SEQ ID NO: 14472 - protein, 152 aa, Actinoplanes utahensis
MAHQGLFPAHRWILAASCCLAWAALGGCTGDDKSVSAPAPSVTTVPVEATLPSLAPAGLKQQAIGHDNVTGGWTADLAGDGPVDITIVCIGGGDLAVNYHNPSRPLGSFKLPCDGTTSKNYDDAAPSGPITVTIKPDGDQRWSARLARGPRS

SEQ ID NO: 14473 - protein, 210 aa, Actinoplanes utahensis
MFGRGVVRTASGYTLTPGGDARVRAATAYVAAHRAALPGGDRIRVVFTGGWPEASAGAAPPPVGAREGDLMLRAARAAGLDEHAELYAETRSRSTLENLLHTVEDGLLSGYAFDARAPLGLVTHAWHLPRVRFLAGRVLGLTGPALRDVPAHGGEVHDDRGALLLARLGFAGARADRLLRRERGMVAVGRLARRVINGRPGYRRRTVGQQ

SEQ ID NO: 14474 - protein, 240 aa, Actinoplanes utahensis
MPYVVLLPVFKPGPHLSELVTALLADGPRPAEVVIVDDGTGPAADARLAELAARGCTVLRLPANRGKGVALKTGFRHIRSRFPEADVVCADGDGQHSVAEIREVADRCRPGRVVLGVRRFDRMPPRSRFGNTVTQAVFRAATGRTVSDTQTGLRAYPADLIGDLCAVPGERFEYEMNVLLHCAATDHPIDEVPIPATYLDDNAGSHFSGLADSARIYVPLLRYALLSRVAPASTVPAERR

SEQ ID NO: 14475 - protein, 448 aa, Actinoplanes utahensis
MVDAQWPGIRRSRAAVPLLVLLLAVLSGCVAVRVSSGQDDSGAAPAAGSADADALVTKAVKDVERFWTAKYPSLRRGRAFEPITGGLHPYTRSDPPPPCGGAQTAYQPNAFYCPDGDFIAWDAQTLIPRLLQQFGPLLVAVVFAHEYGHAVQSRLGVTGQPTVVLEQQADCFAGAWTADALAGRSPAFTGITPEQLDNTVAGLLLLRDQPGTSAAAEQAHGNAFDRIRAFQDGVEKGVATCAGYDADTIPVTEVPFKSRRDAANGGDLPYADAVADLADDAQQYWSRTFPQLAQAQWQAVRVEPFEGTPPQCATPDSTAGGSAFYCQDGDFVAFDNARLGPQLYRNIGDNAIGMLLGDLFARAAQDRRGRSTTDRAGQLAVDCLAGSWTNDLLRRPEGASLTLSPGDLDEAVAALLALGRAGGKSGTSAFDRIAAYRSGVLQGVSACS

SEQ ID NO: 14476 - protein, 469 aa, Actinoplanes utahensis
MPVLLGIILAGAAGAVAVTAATPARAAAGCRADYQVTNSWQGGFGASVTVTDLGDPVTAWQLTWTFPAGQSVTQLWNGTVSQSGAQVTVTNASYNGTIATGGTASFGFNGAWSGSNPAPASFALNGTTCTGTVPSISTSPSASPSASPPTSPGGLPCDLYAAGGTPCVAAHSTTRALLSTYNGALYQVRRASDHATRDIGVVSRGGPADAAAQDTFCAGTSCVITVLYDQSGHGNNLGYQGTGGIGGADTAAGATREAVTVGGSRVYSLYINAGNSYWRNGSASGIPTGSAPEGIYLVTSGTHVNGGCCFDYGNSETTRRADGAGAMDAIYFGTSCWFGGCSGTGPWVQADLEYGLYPGGSRTWNPHQRAFPSRFVTAMLKNNGTSRFAIKGSNAQSGALTTLWDGALPAGYSPMRKQGAIILGSGGDCCIDNTNQSAGTFYEGAIVAGYPSDATDNAVQAGIVTAGYR

SEQ ID NO: 14477 - protein, 514 aa, Actinoplanes utahensis
MASRPRLRGILPAVGGLLAAMITGIAPAQAATTGPCDIYASGGTPCVAAHSTTRALYGAYTGPLYQVRRSSDNATRDIAPLTAGGVADAAAQDSFCAGSTCLITVIYDQTGRNNRLTQAPPGSFQGPAAGGYDNLANATTAPISVGGHKAYGVFVAPGTGYRNNTTNGVATGDQPEGMYAIFDGTHYNGGCCFDYGNAERNSRDNGNGTMEAIYFGNIKVWGYGTGTGPWVMADLENGLFSGANPGYNANDPSVSHRFLTAIIKGEPNHWAIRAGNAQSGGLSTYYNGSRPNASGYNPMKKEGAIILGIGGDNSHGAAGTFYEGVMTSGYPSDATENAVQANIAAAGYATSGSGGGPVITPGSTISLRATTACCTTRYISHSGSTVNTAVVTSGSAAADKANASWIVRAGLANSSCVSFESRNTSGNYLRHRNYQLTLAANDGSALFSQDATFCPQAGRNGQGNSFASVNYPDRFIRHYANNVYIASNGGTNAFDSATSWTDDVSWVVSTPWTP

SEQ ID NO: 14478 - protein, 79 aa, Actinoplanes utahensis
MPGYAALRTIRQRKDTAMTNVQQPELRRSGESPTTKQRTEDAHPTEAPHGSHDKSGNRATPAGQTSPYGPSGKTADDGS

SEQ ID NO: 14479 - protein, 374 aa, Actinoplanes utahensis
MKLDFVRPLVDRTGSWVSVYLDATRAGENADHEVGLRWRALRERLTGDGADSATLDAVEAAVKDHPYQPGRYGLAVFARDGEVAMVETTPAPPPVDEAVTGALPHLMPLIAQRGEQIPYVRVLTDRTGADLDALSVGGATRHREVTGGATFPLRKVQAGGWSHRRYHQAAEESWKRNAGDVAAAAADLADSAGAEVIVVGGDVRAVQTFAGRLPRRWQDRVVRTDAGSRHAGADESPLDDVTIQAIAEVADRHTREAVDRYLAQRGDGTAGAGLTDVVTRLQRGQVDTVLLVDDASSTDTVWVSPDDPTLISVDDHPLREAGVPSPQRVRADAGLLRAIAATGADLVLVAPEEVALEHGIGAVLRYADAGSAAR

SEQ ID NO: 14480 - protein, 333 aa, Actinoplanes utahensis
MAHPPIEPYATGMLDTGDGNAVYWETCGNPDGLPALVVHGGPGSGCSVGMRRSFDPQRHRIILFDQRNCGRSTPHASDPAADLSRNTTEHLIADMERLREHLGVQKWLVSGGSWGVTLSLAYAQRHPDRVSGLQLVSVTTGRRSELNWLYRGIGRVFPEAWARFRDFAGAAEYRLPTDTEPPIEGLLASYAHLLEDPDPHVRQRAATEWLAWEDAVISMEHNGKPGQYSNRLDDAKVAFVRICSHYFANGCFLDDDVILRDAGRLAGIPGVLIHGRADLGSPVLTAWELARAWPDAELIVIEDSGHTGSTGMQEALHAAADRLHERITTPVRA

SEQ ID NO: 14481 - protein, 289 aa, Actinoplanes utahensis
MQIRPFARGDREQVTALVNAHVAAVVPGLSVSVQTLLSQLEREPGETVVDPWVTARVTIVAEERQRVVAAAHLLRYDGAGDYRDAGEIRWLVCRPEHVDAGDALALAGHALFRRWGVARRLADGGLPAPGVYGVPAQWPHVRGIYERAGFRQTGRTETVHLARVADLARQAVPLPGLTTRRTVGGTGTRIAALRGAEQIGYIEVDTDLDGGPRMSRAGCWADVGNLWIEPACRRRGVGSWLLGQAADWLDLGGTTRLLDYADEGEDGYAGFLTAVGFTVLTSTGRRFTA

SEQ ID NO: 14482 - protein, 250 aa, Actinoplanes utahensis
MIKSRFVIPATVLALTGMLPAAPAFASASDPSWESVQVTGVGEVYGEPDLLTANFGVETTAPTVAAALDRADTAATRMRDALLRAGLTRTDLLTSSVDVNQARDNDGKATGYTVDQGITAEIRDLPKAGAILSATIAAGGDAARLNGVSFSIENDSALLATARSRAFADAKGKAEAYAKQAGRPLGRVVKVTESAPDLPAPGDQIRAVSSAMFPADSPVPIEPGRQRLSATVTVEWLFARTPAPKVAARG

SEQ ID NO: 14483 - protein, 178 aa, Actinoplanes utahensis
MRRARRHRADGDREGDAGSGKVRWPVGGQRRPGVLTEVWDRDDVLSRIGYPLPVAVRQPVTADWSVERTAGLRVQAADVLRFVGPGRTVQVEPFTLPAGLAPDTGIAEMSGMLPDERAGELTERDGEVVRRAFCLDAGEQHEFYGYVAKPGHLIAVTCRYDDPADRDWAERVWRSVGR

SEQ ID NO: 14484 - protein, 216 aa, Actinoplanes utahensis
MHDQDQLPMALYDVIHRRRDVRAEFTGDPVPPPVLDRILTAAHAAPSVGLSQPWDFLIVRDRALREAFHEHVCHEREVFAATLDGAAATRFARIRIDGILESTLSVVVTYDPRRGGPAVLGRHAIADAGLYSVCLAIQNLWLAATAENLGVGWVSFYREPFLRDLLGIPPAVRPVAWLCLGPVSRLQETPDLERHGWRHRRPLADARHENRWRACS

SEQ ID NO: 14485 - protein, 418 aa, Actinoplanes utahensis
MPRIGRVALQVGHVDVRDRPAADPPADPDPGRLLIRLGQPPADRPQPPENLRWHVCGLGHGPDPIRARHRSARTAPAGTPGYRRGTSQPEGTQPDMLGLLVMAPPLQRRAGNPGSRILSVASYRPRTEVGNEAIAALIDSSDEWIRRRCGIESRRRAAPDEDLVMMAAAAASKALAGAGVDPCDVSAVLVATMSHRGRAATVAPLVADALGATPAAAMDLAAACAGFPYALATADALVRSGSAGYVVLVGAERMTDIVDEHDRGTAFLFGDGAGAVVIGPAQTCGIGPVVWGADGSGSALLQYDEAGILRMAGPEVFRWATAVVPDLARRALDAAGISADDLAAFIPHQANLRIISATAKALELGPHVRVATDITTNGNTGAASIPQAMAALPDTTGPALLVGFGAGLSYAAQVVTLP

SEQ ID NO: 14486 - protein, 204 aa, Actinoplanes utahensis
MVKTTEEPQPWTAATASASLGGGPARTCRVSRESDGTLRLSLTGFAMIGVDVALLWTQNGAGFSIIGTVVPPPAGAVPGVYMRVDTNMGAVDRRRSRRVSVQVPVVLILPSGQMFPGLAIDLSLGGARVIVDLDVDDLGEEALIDMVDGLAPGQSVTLEMLLPDGPADINCHVRGSDEPGDVRLVFVDVDAEVHRRLDAFQKTQ

SEQ ID NO: 14487 - protein, 148 aa, Actinoplanes utahensis
MARRRTRSDHDSVKQYRDLGDPLDGADVVLIGLFSAREKRYETTLDEIAALVEARGGRVVARYVQRRGASDRWKRRPGGSRRMSQPFSRRTLLTHGKVREIARACAEADIDAAVFVNTLTHRQRSVLAGILGCLIVSGDDLSIPGGTG

SEQ ID NO: 14488 - protein, 489 aa, Actinoplanes utahensis
MLRRLLTVMAAAVLTATALVAGPGTASAAGTLPCDIYAGGGTPCVAAHSTTRALFGAYSGPLYQVKRWSDGATGTIGVLGAGGYANAAAQDSFCSGTYCTIVKIYDQTSKHNDLTIAPGGGANPTADQGANAAALPITAGGHQVYGIYLSAGNGYRNNATSGVATGSQPEGMYMVTEGTHVNDRCCFDYGNAETNNRDTGNGDMDAINFGTECWFTPCAGGPRVQADLENGLFAGGNGVNTTNTGRGSAFVTAMLKNNGTTTYAIKDGNAQSGSLATRYNGSLPTQAGYQPMTKQGAIILGIGGDNSNGSVGSFFEGVMTSGYPSDATENAVQANIVAVGYTKSVTFPVSGSSYRLTNVTSGKVLDATNCGTANGTPVRQWTSLGNTCQQWRFTSVGANRWTITNVNAGRTLDAVNCGQALGTAVDLWQSLGNTCQQWAVIPAGNGKYELVVENSGMVLDNQNCGTADGTPARLWMWLNNTCQLWSITS

SEQ ID NO: 14489 - protein, 482 aa, Actinoplanes utahensis
MDQDEAPVLAAIEQYRDAGDITFALPGHRLGRGIDERTAGVLSRGAFAADVITAKEAAGAAETLYADAAGARDAVFTTCGSSISMHTAVLAMTGPGRKVLTDRNVHKSVAASLILAGAEPVWLRPRWDHRRQIAHPATTGDVRAALDADPEIGAVLIITPTEYGCGADVGGIAALCRERGIPLLVDEAWGAHFAYHDGLPTAAVRAGADLVVQSLHKAGGGLCQASVILLGGDLVDPVDVRLRLDLITTTSPSALLYGSIDGFRRHMVASGERILDAALDRADRLRERLRQTPGLTVMDASIVHEDGVAEWDPLKLSVDVSGLGITGYQARDWLQAEKRLTVQLGDARRVVCSLTYADDDAAIDRLTEALEELAAKPPAADRPAPHLPDLEKLNLEQAMGPREAYFARTEQVADPAGRISAEMISPYPPGVPAVLPGERFTPEVVDYLRAGLAAGMTLPDAADPTLATFRVVVTPRPGPGAA

SEQ ID NO: 14490 - protein, 497 aa, Actinoplanes utahensis
MIYRAGVWNTQRWFASVLVAMVVLVLGASVVGAHLLNRTAAVSNRLSDRISPARTAVVQLDGALREQEAAVHGFLLSGVTDFADSYQQAVGAERQDEARLRELIDDQPAALADLTAVEEQAATWRATVAEPLMQAATTGTGDAVRARAAFTSVRTRLTDLDNRLVGARAAGRDALSESRRIRDDVFLTLIGGLLLFIVAIGVLLRLIVLGPLARLGGEVRRVAGGDFEHRVTPRGPADVVALGHDVEAMRERLADALAESRQQQVTLSRVNADLEQFAYVASHDLQEPLRKVASFCQMLQRRYGEILDERGRRYVEFAVDGATRMQRLINDLLTFSRIGRVYDGWEPIDLNTVLDRAEDALAITIGETGAQIVRPQLPTVPGDSTLLSMLWQNLISNAVKFRHPDRTPRVEITVEPDGDLWAFTVTDNGIGIDASYADKIFVIFQRLHQRDAYPGTGIGLAICKKVTEFHGGTIALDPEHRDGARFVVTLRRDRAGE

SEQ ID NO: 14491 - protein, 505 aa, Actinoplanes utahensis
MEIAQPGRGARRLGFGIAAALLTTGLMGTGPAHAATPVPPPGPGWLDAGGANVAVPVIKDAAGAKLKTTKVDTASLTGAGIGVALIDSGVAPVPGLSQPGKVINGPDLSFESQTPGLEHLDTYGHGTHMAGIIAGSDPANGFEGIAPGSHLISLKTAAADGAVDVSQVIAAIDWVVTHRNDPGMNIRVINLSFGTDSVQPELVDPLSYAVESAWRQGIVVVTSSGNDGAARMTMPAANPYVISVGAADTNGTADRSDDTVASFSNRGTATRHPDLVATGRSVVSLRDPGSYIDTTYPTARVGDRFFRGSGTSQAAAVVSGSVALLLQQRPALTPDQVKRLLMQTADPLAVADPIGGGAGQLDVAGAAAADVPRTADVTQAWPAATGLGSLEASRGTAHVVDGVTGLALTGERDIFGMPWVPATWAATARIGRAWTGGTWNGAVWTGTGFVGSTWPVTTWTGRSWAGRSWAGSDWAGRSWAGGTWTGRSWAGGTWAGRSWAGRSWA

SEQ ID NO: 14492 - protein, 816 aa, Actinoplanes utahensis
MAKRRRLTPNAAVLTLVAVLTIVVAFGEAAAWLLFGPPTPGGLHVPLLITLTVLFALVERFTVTFPVRRGAHAMTLSEIPLVLGLFLVPPVLLIPIRLVGALAGLILLRGHRGGKLAFNTALYLTQATVAGVVFHLIRAGTAPYGPVAWGAAFAAAFAADVVSIVLVTAVIAVHDDSQEWRRLLTADVKQVFQMPLVAVTTTLALVTVLLVREQVLAVLLLGVLAFAAQRVFHRYAQQSRTHQQVEDLYRFAQSLDGLTGADEVARAVLGQVRDLVRAEEAVLIVPGPQSEVWTSMRLYGRDRYRVEATPADAWWLPARSGTPVVRDTAIAVPLRLDESTGVLLVTGHMSEIPAFTADHVLLLQAMSSHAGAALSAVRLLDRLTHLASHDALTDLPNRQRFQADLQAATEAAGATGGTVGVLLMDLDRFKDVNDALGHDIGDDLLRRIGRRLRDSFAGLGVVSRFGGDEFALLVRDAGSEAELVALAEEVRRTVEKPAAVGDLILAAQVSIGVCLAPEHGRDAARLLRRADLAMYAAKAAQAGVRVYRPDDDRDTARRLTLMAGLRTAVDNHELSVVYQPKVDPRTGRVLGAEALTRWQHDGRPVPPDEFIPLAERCGLIGPLTRHVLETALTECATWRAAGHDLSVAVNLAPGLLSVPDLTDRVDQALRRHGLPPSALTLEITENGIMSEPEHARRALDALDRLGVKLSIDDFGTGHSSLGRLAHLPIHEVKIDKSFIRHIDTDRNRRAVTDAALQLARALDLQVVAEGVEVEAELDYLRRNGCDAIQGYLISKPISAPAFLDWLTVTVPTSLAV

SEQ ID NO: 14493 - protein, 177 aa, Actinoplanes utahensis
MDLGVSRRGYGYDRGAATLYMFGIILVPFLIFMTLAGAVVAFVPAEQRQDGGGAIRFLLLLLCFGSLLVGGYSVWFLRVAGTDRVALFTVFDNGLAYGHVADPFTMRLAAPHSVLIPWFDITELRERGPGSSVLRALLPPGRRYRLDIVTRDHRVLTLTGAIQNARELATVLRSHVG

SEQ ID NO: 14494 - protein, 346 aa, Actinoplanes utahensis
MVAELPRMDSVTPILRVAAARLDDGDAAFVADLGIALWLRYRWETAPPQVTEAFEQLLRLLLGRPGVLDQAVRLLCVAGDRRTERVAASMIAARQPTADLGVVFRADAPAELRACLAQELVLRGAEIDPRWVDPTHPLGWLPPSLTSLDASPALPVHQDGRVHLETPELEGERVHGHGGVPEWRETTTSDRSALLGAAVAGWVRRSNGRIEARTFAFDRALSPDAAAGALVSIGLHSTEGMTAGLLTCSPSQAWERLFIAAAYGAAYEPGEAGAYGRLYAWRSVAGLVGAPADTPVHEVAAVAHGCSWYSFAGATRWFEDVVGDLGLAAVAPDRRGLAVLAATDTD

SEQ ID NO: 14495 - protein, 63 aa, Actinoplanes utahensis
MTPIGGDIPKFLSVVESADDRVRVEVTNPHLVTIGELTAEIRDGKIVITTASADHLEFVVIRP

SEQ ID NO: 14496 - protein, 66 aa, Actinoplanes utahensis
MVALARWGPDTLIPDLTPHALPGHRVTASRHEVIDPYIPVIVLAARTATALGVIAVATRRPRITAG

SEQ ID NO: 14497 - protein, 265 aa, Actinoplanes utahensis
MTAALLVAAAVAYLAAVRAGRRRGRGWADERTACWLAGLTAAGIALIGPVAAAGHHDFAAHAAGHLLLGMAAPLLLVLAAPVTLAFRALPARWARRLARALRSRPVRVVTHPVTAAVLDAGGLWLLYGTGLLAGRHPGLVQLHILGAGYLFAAAVVGVDPAPHRPGRAVRAAALIGFLTAHAILAKFLYAHPPAGVLLREARTGAEVMYYGGDLIDLALIVIFWWQWYRAGDSGRRWPRPPAPAAWRLPAERPMPSRSLASSRSG

SEQ ID NO: 14498 - protein, 144 aa, Actinoplanes utahensis
MSRTVLSGALLGLGVAGFADETVFHQLLHWHHFYDRSTPAVGLVSDGLFHAASWFCTVAALFLLADLRRRAAFDRRSWWGGLLTGTGAFQLYDGTVQHKLMRLHQIRYDVNLTPYDWAWNIIAVLLLAAGVVLLARSRRRVVPA

SEQ ID NO: 14499 - protein, 892 aa, Actinoplanes utahensis
MPLRSVAVLAATILSLPGALPAHAAAAAAPTTITVGNARFQVLSPTLIRTEYSADGRFTDAATFTVVGRGAFPRAATVVRRSLADGWLTVDTGAATLRYLVGSGPFSQDNLVVRLKSGQQQVDAAPWAGPSCALGVLCEAETLRAPATATDHGGYTGTGFAAGFGAVGDGLAFTTAATTAGTYQLDLRYANAQGADGQNTTRTLSVIVDNGAAQRVTLPPTGSWDTWQVATAAITLGAGHHQIAIAHTAADSGQVNIDSVAIVRPGDAYPPVPTATASPCAYGSLCEADTGVLTGGAKHAADHNGYSGAGFLAGLEHAGAGAAYTITGIPAAGDYTVQLRYANFEAGSQPVQSRTVTVNGTSATLPATSGWDYWRTVAIPVRLKAGTDTVTLGCPTDASCNINVDTIAVAATGTPLKAPHAPLGGYRRGLDGVDGGALTAAGLLYADGWALLDDSASARAVPEQDGYVFAYGKDFARGLRELGTLTGPTALLPEWAYGVWYSEYYDRTAADFQQRIVPRFRSEGVPLDVLIVDTDFKSPDTWNGWEIDPAKFPDPQGFLDWVHGQGLHLSYNIHPSIKDTDPKYAQAQAIAQNKIKNGVFDWGDPDQLAAYLWLHNDLKQDFAWLDWCCDGSYSSKAGVTPDSWINQQYAGRYGFAFSRGYGSLQSGGYSNPAAVPTGPWAEKRTTLHFTGDAISDWQTLRFEVGYTPGESAATGLAAVSHDIGGHTGGLQQPGSEPGSTRLPDDLYARWVQLGTFQPIDRLHSNHSDRLPWQYGPDAAASAKKFLQLREQLRPYTYAAAQTANRTGMPINRALYLAYPDSAEAYAYAGSEYLFGSDYLVAPVTTAGTTATTTVWFPPGNTWTDYFTHQTYAGGTTAQITTTLSTMPVFTRG

SEQ ID NO: 14500 - protein, 116 aa, Actinoplanes utahensis
MGIRSGSARSIRSRWRHCGPPTGCRVRRRGPARWCDLLSRSPEFARLWEAQVVGRRFEEHKVLLHPRIGAIEVDCQVLLTEDGSQSLLVLTAAPRSEDESRLRLLTVLGTEPFSRA

SEQ ID NO: 14501 - protein, 127 aa, Actinoplanes utahensis
MKKVLVAVSSSLISFGTAAPAEARQVARPAVAAESRSAAGTRAAAYLRSQAFSRSGLIEQLKDDGFSTGLAVHGVDEQHTDWNQQAAWMAMEYLETEAFSRSALVEQLEYEGFTSAQTAYGVRAAGL

SEQ ID NO: 14502 - protein, 299 aa, Actinoplanes utahensis
MNLHVAEPRRPGLRVEVTAGRRLLLRQGDRVVLLGRQRAHHRGVHYCRTGRYESPLPPITARQARGRWQAGNESGWWAARWTYRYAAWLRTAFYGPLHAGSWTLAWGMPEWTVPGHWSRLHDVDPDQGHITWFGYGDPSEDARDILPLRRLSAVDADRVKAYRRQHREGILPPVLLWWVSGLATLLVVDGHDRLTAALAEGAVPDVVVLAPTADPRWVSAVQRHPIREYEQRIAHLRNGPTDPFTGDGIAHAGHRLAANLSRIALTEGRTRAWPMLGGRPTWDHLVAEFAPGSPLEQER

SEQ ID NO: 14503 - protein, 220 aa, Actinoplanes utahensis
MILPRLDSMRNTRQLRMYGALCVVRLAEVAALGDFPYRESLDRYLDGLFDERRGSPDDRECLMRARRFLFGDDITLIKYYQSITVEIALTIGGDEPSRPLSARGILFSTLNPWSNLDGLCRHATPPQFDEDHFRNQEMRLQDDDIADIVHSPDTADSWTPLKSRARLIGERVAASLNGLSQELRWPEERGIPGFRVATADEQEEERLSSLVDNDAPADHG

SEQ ID NO: 14504 - protein, 232 aa, Actinoplanes utahensis
MPPPLPGALRRALHTSGAAAYFACCPAGAISSQFHHSCKNGHVDGRRYSHAVDVDWNAELVDQLESHWHAQLRPRLNGLTDDEYFWQPVPGCWTLSRRGSEEFVLDYAHPLNGPAPVTTIAWRLAHLLDVFGPPATPHFEGSPGGQTAMTYPGTAAAALRQLDGGHDAWVRDLRSLGATGIIRAQGAISPPEYAEAPMAKLILHTHREVIHHGAEICLLRDLYLGKGGLSGL

SEQ ID NO: 14505 - protein, 31 aa, Actinoplanes utahensis
MTGPTAGATGREQTGDHEDDMTGRWGPEAAR

SEQ ID NO: 14506 - protein, 229 aa, Actinoplanes utahensis
MSRCLVPPSCHFRPAPPAAGSPGPQHEVVHVTTTDLESPVFRRFLLIPLVLAPLAACGQVTGAAATPEPGASSSAATATKVIPAAKTQPASGHGSAGSAQAGGTTTAALTGTHHAFLTAVDPAKHTITFDLVDWFEGAAAKSACKQDGVTETANDWCVGYYYRNNSHKLRTLHVKSGAPLRVIDMSHGPVHLVTADLGKFQTSLKANGGLFVFTVTNGDITKADEVYQP

SEQ ID NO: 14507 - protein, 451 aa, Actinoplanes utahensis
MRPAARLTSGPVRLHGLPRGDRWALAGVLGLVAAAAVVGAALGGAGHPVLAPAAPIFGHVRPHIGPGTPLALAVAIAVIRWGPALAATLPWRRLLVGAWLAAVAWTFSLALIDGWQRGVAGRLTTQFEYLSEVPRVTDIPAMLRGFTSHILLNSPDHWAEHVSGHPPGVLLTFVWLDRIGLGGGAWAATVCILVGCLITVAVPSTLRSLDSDGAETAARAAVPFLVLFPGAVWIGVSADGMFAGIGATAVALLAAGLARPSRRRLLLGGALLAWCAYLSYGLVLLVLPAATLLVGRHRRWPLLIWPILGAAAVVAALTGYGFAWWEGYHLVKIRYYQGIATARPYAYWIWANLASLACVAGPAAAPMLRRAALALRAARGPAAWLCLGGLAAALAADISGLSKAETERIWLPFAVWLPAAAVLLPLRDRRFWMCLQAATALLVNHLILTTW

SEQ ID NO: 14508 - protein, 524 aa, Actinoplanes utahensis
MHRQAGVPADPVGQDRVRQPGVGRPRAGHGRPAASAGQVQLAGADPVGEQRQLGRIQRTVRVDHAHHPVGRVGGEQPGVHGRAVAGVRHVDHPGAEPAGHVRGAVGRPVVGDDRAEAGRHPVQQPRQGRGLVQAGQHHIGHGRKVSAGQGPEILRSADVADSSYEPLTDRRGPVSTAARGPSVAAVTHILVTGGAGFIGSHVTAALLAADHDVSVLDSGPGEVPAGVRLHRADVRDPEAVRAALRGVDAVVHHAALVGLGVGPQDLPDYVGSNDLGTAVLLAAMAAAGVRRLVLASSMVVYGEGAYSCTTHGPVSPAPRAAGDLAAGRFEPSCPRCGRPLLDGLVGEDAVMDPRSVYAVTKLSQELLAGVWARECGASVAALRYHNVYGPGMPKDTPYSGVAAMFRSALEGGRAPRVFEDGGQRRDFVHVGDVAAANVAALRAERPGFRAYNIASGHPITIGAVAAALSEAFGGPGPVVTGEFRLGDVRHVVASPARAAAELDFRAAVLPSVGLKEFACAPLRG

SEQ ID NO: 14509 - protein, 267 aa, Actinoplanes utahensis
MIQLLVMAKAPVPGRVKTRLCPPCTPEQAAAIAAAALADTLATASTLPARRHTLVLDGEYPVPPGWACVRQRGDGLGERLANAFADTALPGVPALLIGMDTPQLTAALLRAAATRLRNEGAVLGPARDGGWWALGLPIAAYATVLPAVPMSTAETGELTLAALRARGVEPTLLPTLRDVDTAADATLVAALCPPGSRFPAAVTTAGLTAVGLTAAGLTNAGLTAAPGRAAASPAGVGADDELGGSRIADGAGSGGDRACAATTGVPA

SEQ ID NO: 14510 - protein, 104 aa, Actinoplanes utahensis
MRCYDWGAGVTAPAIACPPAALDIYDRALARAATGAGTTLLVRDPAGRTTRFDAADWCRDHRPGDTRLLDRCTGATLDVGCGPGRLTGALLRRGRAALGIDVTS

SEQ ID NO: 14511 - protein, 71 aa, Actinoplanes utahensis
MHAELAAPGTGSWSGAATLHTPGEPAGAPLRWAQVAADDLAAVAREAGLTVLSTWTEEGRWFASLTGRGAR

SEQ ID NO: 14512 - protein, 473 aa, Actinoplanes utahensis
MVRLTDRSGRPVNRLPRPPEPLRRAVAWLLAPPASLRRGPFRPDAFSGDRRSTRLTGQLGLLLGAAFAICFVTGLLSHLAQHPNRWLPWPPGPAGLYRCTQGLHVATGLATVPLLGLKLWSVYPRLFQWPPVRGLGHAAERASVAVLVVAALFQVLSGVLNIAHWYAPMPFFFTTAHYWMAWLAAGALLTHIGVQLPITREALRRRRSDPAIPVGAADSGSPVDSVDSGSPVDAAIPGGAAGPVHPAGPVHPAGPVHPAGPVDSASPAGRTDAAGRREVLVAGAVAAGVITVATLGQTVRPLAGISLLAPRRPGTGPQGLPVNSTALGAGVRDAALDPGYRLTVTGFDRTVSLSLPDLHALELHTSVLPIACVEGWSSTGTWTGVPLIDLLAMIAVTPDGCEAVVESLQSGGRYRTSIVQEGHLADRRTLLALRLGGEPLAPDHGFPARLIAPNRPGVLQTKWVNRITVRRAG

SEQ ID NO: 14513 - protein, 134 aa, Actinoplanes utahensis
MRRVLIAGGLILMAYAVGGALLDDQVDLAGIAVFGLAVLILHDVVFLPLVLLAGRLLPRLTPTLRIITTAWLAVTIVALPLVLGFGRDPGNPTILPRSYGTDLIGILIGTAVTVLACRKGIERLSDGRRRRPPG

SEQ ID NO: 14514 - protein, 138 aa, Actinoplanes utahensis
MVTHQVLVVDDDPTVSDVVRRYLEQDGCHVRLAADGLSALAAVDAQRPDLVVLDLMLGGLDGLEVCRRLQHDQPGLPVVMLTALGEESDRVLGLEVGADDYVTKPFSPRELTLRVRSVLRRTAPAAAPAPALLRDGDL

SEQ ID NO: 14515 - protein, 49 aa, Actinoplanes utahensis
MWGWQFGDQSTVTVHVRRLREKVEADPARPARLVTVWGVGYRWEPAADA

SEQ ID NO: 14516 - protein, 337 aa, Actinoplanes utahensis
MRDILLIGLYSLAAGTAVGVCGAGLLRLLRGRSIAVHVCVLLGITITAVVAGVTTVARAMFLSAHDMQVVLLTVAASALVSLALGIVFGRRLAAAAVWAAEARERERRMEAGRRELVAWVSHDLRTPLAGLRAMTEALQDGVVADRAGVAEYHRRIAAETDRMSGLVDDLFELSRIHAGTLRLTPASLPLRDVVSDAVAAVGPLAAGRGIRVVAACDSWPTVTGGVAELNRIVSNLLTNSVRYTPANGIIEISAGGDTREVWFAVSDSCGGIPEEDLPRLFDVAFRGSRARTPDDGATGAGGGLGLAIVRGLVEAHGGRVGAHNITGGCRFEVRLPA

SEQ ID NO: 14517 - protein, 458 aa, Actinoplanes utahensis
MGHPGQDTLRLAPAATLRCDDHDNRSGWPQDTGQREAHQGPGGTCPPSARRERGIAVIRLPDPQRSYAVLVGVWSYDADEILDLPAVENNLSALRRVLTDPDRTGLPAEHCITVRNPRDARGVFRKLRQYAARAEDTLLFYFAGHGFTGDRNELYLSLSETHPDELPVSAIAYDVVRQLVRESPARNRVVVLDTCFSGLAVQDMAGNPAATVLGQVGIEGTYILTSTERNAPALAPPGARYTAFTGELLRLLVNGVPEAPRLLTFAEIFRHLLTAMLARGLPVPGQRGTGTIDQLALTQNAWQDRAAGPAIGSRPAHPYKTGAGGLRIRRAVFDGIVAHCLAVHPITACGLVAGPIGSNRPERFIPMWNAAASMTFYEFDPHQQLAVWREMDANDEEPVAIYYSHTATEAFPSRTTVAFAGEKNAHYIIVSTRDPDAVQFRSFLIRDGEVTEEPVEVI

SEQ ID NO: 14518 - protein, 212 aa, Actinoplanes utahensis
MRAETTRLRADAQRNRDQIVAVARVVFAEIGPGAPMDEIARRAGVGVGTLYRRFPDRGALLRAVALESLAAVLADAHAAIEEEPTAWDALTRIVRRAVDLRFSTHVTMMDEHTRQALREAPDFRHTRAAVLGVVEHLVERAQAEGSMRSDVGAGDVFAVVSLLLKPPPSRSAEMSDLLMRRCMTLILDGLHSGGQSVLPGDPISVTDLHLDS

SEQ ID NO: 14519 - protein, 395 aa, Actinoplanes utahensis
MTAPALQTTRRCPYAPPDEHTRIRDTGSGISRLTLPSGQVAWALSRLEHIRAMLTDPRFSSDRQHPNFPRFTREQPGFDLMRPSIIQLDPPQHGPARKAVVGEFTVRRMAALRPRIQQIVDDHIDAMLAGPRPADLVPALALPVPSLVICEQLGVPYRDHEFFQSHSSALLSRAVTAEYRRQAATELRDYLKDLIAEKAADPPDDLLGRQLAQGNDPEDVLSLAFLLLIAGHETTANMISLGVVTLLERPADLAALREDPARTLPAIEELLRVYTIAEFANSRVAVEDVPIGGVTIRAGDPVLALSNAANHDPSAFDEAEEIKLDRGARNHVAFGFGIHQCLGQNLARMELQIVFDTLLRRIPTLRLAQPADRLPYKDDAFIYGIHEVPVTWEDA

SEQ ID NO: 14520 - protein, 66 aa, Actinoplanes utahensis
MTTIVADLDRCVGAGQCVLTDPDAFDQSEQDGTVVVLRDTPADDEAVERARTAVDICPSRALSLTN

SEQ ID NO: 14521 - protein, 144 aa, Actinoplanes utahensis
MHLSPPLRHWHPARDSKRLISEFLHTPSELMVLAGVWLTAAPLLFDHQAAVVAYAGWSDVLSGLALVVLAYVRAVDPFGTDWVNAVTGLVAVWVMVSPFVRGYTGSTTATWNDLITGAVVIGLSAASWHFRRSEARRQGMEPPE

SEQ ID NO: 14522 - protein, 84 aa, Actinoplanes utahensis
MTSTITPYEDGPLIVRGDFELRTPDGDVIDPARATIALCRCGKSADKPFCDGTHKTFRFRAGTGRDNDPPALLTQGGQPAPEGR

SEQ ID NO: 14523 - protein, 361 aa, Actinoplanes utahensis
MVRTVGVEEEFLLLDPATGVNLPVAGRVVAALPESLRRRSRREFRPSMLEMVSDVCVEADDLARQLAQNRGAAGAAAATAGVLLVAVGASPVAEPDREPDDDPRFRAITDFYGPVARDPALCGCHVHVGVDDPEHAVEVCNRLRPDLPLIQALSANSPLCEGADTGYASWRSVQLRRWPALGPWPHAGSVAEVEETVAALVAAGEMMDASMELWWARPSRTFPTVEVRVADVGPAPADAVLLAMLVRGLVETSTEGPMVSDLLLTAAHGNAARSGMGGTLLCLRTGRARPAWDLVGEMVDRIAPALRKAGDLDAVVAGLDRIRREGTGADRQRRLLAAPGTTIPAMLRAFSVSPGDRPATA

SEQ ID NO: 14524 - protein, 307 aa, Actinoplanes utahensis
MTALLELGQALKAAGYEFTTVTPATHARVNARPANAEAHDLRDVFGWSRPFRPAVLPAGLLELLRAADAVEADGELLRSRVRFSTYDGDLFLHSAFPTDAADSVFFGPDTYRMADAVAAHLESRAEPVARAVDIGCGTGAGAITIAKRAPGAEVLAVDINDTALRYAQINARLAGTPGVTPRRSDLLDHVDGDLDLIVSNPPFMVDPAGRTYRDGGGADGNDLSLRIVDAAAKRLAPGGALVLFSGTGIVGGRDPLHTAAAERLSGTDLTWTYREVDPDVYGEELDGPAYAHAERIAVVLLTATRPW

SEQ ID NO: 14525 - protein, 274 aa, Actinoplanes utahensis
MAHKAGDAGHPGRMTFAVVTGASSGIGYELARQLAEHGYDLLIIAEDEGIEEAAADLRRDGRNQVTAVRADLADRAGVAQAWAAVEATGRDVEVLALNAGRGIGGEFVGGTELADELNVIDVNVTSTVHLAKLALPGMVARGSGRVLFTSSIASMMPGTYQAVYNASKSFVQSFAEAVRAELKDTGVTVTALMPGPTETNFFHRAEMDDTRVGSSPKDDPAQVAEQGIRALLEGREKVNAGSLKTRAQAVASKVMPDSAKAEMHRRMAEPGSGS

SEQ ID NO: 14526 - protein, 452 aa, Actinoplanes utahensis
MPDADPGKPADRTPSLPPATSGSAPAPGGRPPGARLGADPDRCLRGGDRGDTAAVPTGSTDGARRAAAGHHGPGGGAGGAGLRICGSAAFSAAFHPSVRGVAAGVPGGGGMMRRLLRIVLALVALSGGLIAIPDYAVATAPEPQIVVVPAFTDPAAAAEAPLRELVNRVHRRGGLVMSVCSGAKVLAATGLLDGRRATSFWADLPGLRHDHPATTWLAGTRWVEDGSVLTTAGVSSGILGALHLVDRYAGPAEAARITARLHYPDAPVPGRHLSLADYPYGLHAVLPWFQPTYGLGLTDGVPETDTAAAAELYGGVGFTARVVPVGDHRIVTTAHGLRLVATPIGDAPHLDRLIVPGVTATTLTGAPTFLPRTAARPGDSAFDPVLRDIARTDGRATAVTAAKYIEYPVPDLPASGRPWRLILLTFALVTVVIAIAAGRWRIKRATQGIRAA

SEQ ID NO: 14527 - protein, 150 aa, Actinoplanes utahensis
MVTHRSGAGDALAARSPLRTAALVVSVVFLLVGVLGFVPGVTTDYGDMTFAGHHSDAHLLGVFQVSVLHNIVHLLFGLAGLALARTVPGARRFLIGGGAIYLVLWVYGLVVGDDAAANVVPLNNADDWLHLGLGVGMIALGLLLSRRAER

SEQ ID NO: 14528 - protein, 705 aa, Actinoplanes utahensis
MVQEIWPGNSYPLGASYDGTGTNFAVFSEVADGVELCLFDDAGTETRHRLCSVDGFVWHGYLPGVAAGTRYGYRVHGPYDPAAGLRCNPAKLLLDPYAKAIDSDIDWDESLFGYRFDDPEARNDLDSGRHMMKAVVVNPYFDWRNDRPPRIPYHQTVIYEAHVKGLTRLHPGVPEHLRGTYAGLGHPAVIEHLTRLGVTAVELMPVHQFVQDHHLAERGLSNYWGYNSIGFFAPHNAYAAWGQRGEQVQEFRAMVRELHAAGIEVILDVVYNHTAEGNHMGPTLSFRGLDNGAYYRLVDDDPRYYMDTTGTGNSLLMRNPHTLQLIMDSLRYWVTEMHVDGFRFDLAATLARQFHEVDKLSAFFDLIQQDPVVSQVKLIAEPWDIGDGGYQVGNFPPAWTEWNGKFRDTVRDFWRGEPATLADFTSRLTGSADLYQDDGRRPVASINFITAHDGFTLHDLVSYNDKHNEANGEDNNDGESHNRSWNCGVEGPADDPDVVALRARQQRNLLVTLMLSQGVPMLLAGDEFGRTQGGNNNAYCQDNEISWVDWSLAESNASLLTFTRRLIMLQRRHPVFRRRRFLRGAPVHEAGEALPDIAWFTPDGTEMADEHWEAGHARTVTVFLNGDAITEQGRRGERIVDDSFLLMFNAHHEPLRFTAPDPGFGKEWAVEVDTADPAADHDETLTAAEGVDLPGRSIKVLRRRV

SEQ ID NO: 14529 - protein, 85 aa, Actinoplanes utahensis
MRTLIVRGGWAGHEPAATTDSFLDLLHDHGCDVRVADTLDAYRDPVAYDLIVQCWTGARFTAEQEAAPHDHRPRDPVGGWQSRRP

SEQ ID NO: 14530 - protein, 792 aa, Actinoplanes utahensis
MPRAPRVEVRHIGRSFPHATPGEADGDFRTRPARRTARPMRLKSRSTRAARLLVAAAGLWLLAGVVFGVAGVCMPVPVWGLWPIGVASVATQVVAALLAAATGVGACRLFWRRLSIAFTLLGLAVISQTRDAVQHPGQVIAMGPLTGALYSAAVCLAVVALVRLPGPVRSRRASVAVWLDIAIVSAAAGMIVVQGLIVLPSPVPDGPLATTLRVIVAAVASAAVLAIVKAGLTGAGAVPRAALWFLTPAGLLGPVSLVLAAAFRSWPHLNSTVAAVLPLGVLITLSAAAQTRANLTCSDTPDTWEAPGEVARRAGISRVPYVAVGATVIMLLAVTLRTGYLPAGLAAGAVVLIVLVLVRQHAALRDNSVLAVRLADQARLDDLTGLPNRRAFVDALQGRTGDTTVAVCDLDAFAALNDRLGDATGDAILRQAAERITLTVGGTALVARLLGDEFGVLLPAGHPLADGDDLATALLHAFQAPLHDLLVTVTVGSAGGRGAAVPDLLRRAELALQAAQRVGANRHQHHTPDLDASAQHHADLAAALRRGLERGEFRLVYQPIVELPLGTLRAVEALVRWHPDGGKPVSPAEFIPVAEQTGMIVELGAWILDTACADAAVWQRRYGAAAPRISVNVSARQLLDPELPALVAAVLDRHGLAPDQVTCEITETAVFAGGPALHTVTALRGLGVGIALDDFGTGHSSLTLLRTCPVTTLKVDKSFIDELNGSPQQEAIAASLSGIATTLGLGAVAEGVETQEQADRLLDLGYRYAQGFHFARPAPAADIDASLLAAVG

SEQ ID NO: 14531 - protein, 639 aa, Actinoplanes utahensis
MSRGLAYLDLLAREAALVEFERPLIAARAAGAPAAELDDLEQAKLLALRVRALLERRRRREEELSALYDTAGDLAGLRDVDAVLRAIVHRARTLLNVDVSYMTLNDQERGDTYMRITDGSVAASFQNLRLPPGAGLGGLVALTGTPYATANYPTDARFAHTTDIDMGVGDEGLVAILGVPMRLGSTVIGVLFAANRAERPFAREEVALLLSLAAHASVALDTARLLSETQTALAELSAANATIQAHSASVERAAAAHDRMTALVLRGGGVDDVAADLVDVLSGALLVIDAHGRTLATARTRGVAATLPEPDGSTVDEAVAASRGEGRSVRRHDLVIAAVVAGADNLGALVFRPDPGPLAAADQRILERAAQVTALLLLFRRTVAEAEAQVRGDLLDDLISRPVRDPDAVRDRAGRLGLDVDAPYVVVVAGEDTGDGLRQRAVSWARTFAAGRRGLAMSRDARVTLMLPGEDPAGTARQVARELSRALGRPVTAGGAGPVRGATAVAPAYREADQCLSALITLGRSGTGAGTEELGYVGLLLGERRDVTGFVHTVLGPVVEYDERRGTALTTTLEVYFDCGGGLARAADALHVHVNTVTQRLDRVAQLLGDDWQHPRRVLDLQLALRLHRLRAPLAVDHT

SEQ ID NO: 14532 - protein, 462 aa, Actinoplanes utahensis
MHMSTTTRAPIVKVVFASLVGTAVEWYDFFLYGSAAALVFGTLFFPKSDPVTGTLLAFGTYALGFAARPLGGVVFGHFGDRVGRKRMLIVSLMLMGAATVAIGLLPTYPRIGVGAPILLLICRLAQGFAVGGEWGGAVLMAAEHGDDARRGFWSSWPQAGVALGNLLATGVLWLLALVQSDEAFKSWGWRIPFLLSAVLVLVGLWVRLSIEESPVFREALAARADRPHRPLLEVVRRYPREILLAMGMRLAENIGYYLVTVISITYLTTFAGTSADKGKILTALLIGSAVQFVLVPLLGALSDRIGRRPLYLAGAIGMAIWSYVFFGLVGSRSEPRIVLAILVGLILHSLMYAPQAAFFAELFGTSVRYTGASVGYQLASILAGALAPIIALTLLGDVHHPNTTAVAVYMTVASVLTVIAVLAAKETARSSLSHDRGFEEAPAPASPGVPAGSTVRGSGSRW

SEQ ID NO: 14533 - protein, 197 aa, Actinoplanes utahensis
MLFGGPVVMAGPLLAVLIVDGLGLPPPAYGLALGVPCVGGIVGSRLAPVLVRRFGQRRVLLAAGVLRTPWMLLYPLARHGTAGLAIVMVADTLTLTCAGVFNPVFATYRMNVTADAYMTRVRTAWGVSAKTVQPLCVLAGGGLAALVGVRTTLFLAGLACLASGVLLPFRSLADDGDHRAGGAGLSVPRRCRTPGAG

SEQ ID NO: 14534 - protein, 359 aa, Actinoplanes utahensis
MHRRHPTTAAGLIAAAIVSAIVSAPTRAAAADPLVPATDRQVTFVVDGTTTYGTVHVPAHHAGKRLPAALLLPGSGPTDRNGDQLPAFPVHTLTRIADVLDTQGVMSLRFDKYGTGQTGLGAFTGRLGELDYPAQLRQAAAAYALLHGQPEADRHAMLLFGHSEGGLSALLLAATVRPRPSGLALLEPLDQRFLDRVRGQQWWRIDQARAAGEITPEQARQDKAGVARVISQFRAGRPVDFGGLDPGLAAELKLFVTGYVERYMRSIDAIDPAQVAGDLPHHLRTLITCGTDDVNVPCESTGALVATLHKIGSTGPGLVTLPSVDHELHTPGAAVDGPLAPAAVAAITTFTARWSHQEC

SEQ ID NO: 14535 - protein, 76 aa, Actinoplanes utahensis
MDFDGRATSRMTAGLPQTLHSGLTPLGEIEQATKIAAGLKVPRHGWRKAVVTIGVGLLALAAAAILVGLLLADAQH

SEQ ID NO: 14536 - protein, 272 aa, Actinoplanes utahensis
MGKSEQSASYTRRLRPPGRQHARPPGTWGLWTPPVDRSGRTVKVALDAERVELKVVATERACRRLDLERHAGQTRRVYFLDTPDLALDRHGLIVRIRDLGGRPDDAVVKLRPMGAHTLPKWLRRTNRLEVEIDAMPGRRVCSGSLKVRLGRDVVSRTVAAGRPLAKLLAQPQRRLLSACGPDGVSLGDLVVLGPVEVRKQKFQPAGFDRQLCAERWAFPDGSTILELSTRCPVGKAPEVAARLTDVLAAHGITPVEPQHTKSDLTLRYFSCL

SEQ ID NO: 14537 - protein, 641 aa, Actinoplanes utahensis
MTTTDGKPAEVSEKQARQVAEAARESEWRKPSFGKELFLGRFQLDLIDPWPAAPDRPDADEFLRKLDAYVRHDMDGGQIERDARIPDEVFQELGRLGAFGMKIDKDYGGLGLSNLHYCKALTLVGSVNGATAALLSAHQSIGVPQPLKLFGSAAQKKAFLPRLAAGEVSAFLLTEPDVGSDPARLGTTATPVDGGFRLNGVKLWATNGTVATLLVVMARVPEKGITAFVVEGDAPGITVERRNAFLGLRGLENSVTRFHDVFVPEENVIGGLGKGLRIALTTLNTGRLSLPAMCVGAGKRALAISREWSADRVQWGRAVGTHEAVAKKIAFIAATTYAMESMLDLCCLIADDARNDIRIEAALVKLFASEMAWQIADELIQIRGGRGYETGDSLRARGERGAEAEQILRDLRINRIFEGSTEIMHLLIAREAVDAHLSVAGDIIDPDAGLTRKARAGARAGRFYARWLPTLAVGRGQNPMEYADYGPLAAHLRYVERASRKLARSTFYAMSRWQGKLERKQGFLGRIVDIGAELFAMSATCVRAHAEKDRQPAGLELADLFCRQARLRAEALFAALWDNTDTLDVKAARRVLDGRYAFLEEGVVNPASDAAWVAPWQPGAATVDDVRRRIPPATSGNVQEA

SEQ ID NO: 14538 - protein, 274 aa, Actinoplanes utahensis
MPHPLSMIRRMSELVEPIGTVTFSAIPNEEFLAVGMRNYWDGYFAGRAAPLGRAPAEVVHAVFYNFAEGEVARHIPWVWGKVSPEEALVLRERGSAAALRGLIGELAHSPALPRVNELAERAALSAPVAGRPLYAGLRALAVPREPVARLWHLGTLLREHRGDGHNAALLAHGIGGTEAHVLLALTLGMRAGEFGRLHHLPGAQLAAVVDGLRERGLVTAAGGFTDAGRQLRDRIEIVTDELAAPAYDVLDADELDELIAGLEPFAAAIRAGDH

SEQ ID NO: 14539 - protein, 395 aa, Actinoplanes utahensis
MPTARNSSFGIAEKVTVPIGSTSSDMRRIMLNGCGIGQLSYGPGGAVRPASRPRYECSAPHPTTAGHFFVRPPPGSLRSMAGSDRPGRETQPLTLRVMTPESFRRRRAEMVMRYAVAGGEAAEAAAARQIDAALPGGPDTPGELLRSAWSGPHEVGWIWASMPGRVVPDLAWIDELVVDEGFRRRGFGEAIMRATEAALAAGGATRAALNVFGGNDGARRLYERLGYTVTLQELTAVPYASPPGPVTLVPLAGPAARIEASVAATAAEFGLGPVQARERVMARQTPATVNAAVVAGGRAVGWVSYSPRHFSRPRSGGIYRLDIDPPYRSVGYGTAAVRAVLTELAGLPGVLTSVPRPAVWLHRLGFRLSAQHMAHELPTGGKRRRRAGSAGESCT

SEQ ID NO: 14540 - protein, 143 aa, Actinoplanes utahensis
MSLSQIILSCGRAIQLTELRMSSTYATMLEGYPCRPVNDMRVSGLRQQAERAFPATPVHLVPPSRDYPDQAAGAFGPVEVLPSVACLGAFRSTAIAAELDPALHRSALIVVWFQAVPDVPSGEDADPALRGIRWAEVAEDYEL

SEQ ID NO: 14541 - protein, 349 aa, Actinoplanes utahensis
MCPVAPVRKTFMVELLSRSDVSPHSLPRLSVRHQRTVPIRSIAKGDYSGRVEQRQLEYFVAVAEELNFTRAAQRTHAVQSTVSASVRALERHLGAPLFDRSTTRVALTAAGKALLPEARRALDALDQARATVTGLRAGLTGSLRVGTLSGLTAIDLPALVSDFRTRHPGVRLSLSMAAGGTDGLLAAVRARDLDVAFVGVQTASVPDLQLDPIATFQPRVLVPAGHPLAGAGTVTPAGLADEPFIDLPPGFCNRIRTDHDFRRAGIARTIAVEVSDITTIPGYVEAGIGVALVPPLAAEVGRRVAAIDLDPPAAPWTLAAASLGNPTATPALRAFLDLVAAHVVRRDRY

SEQ ID NO: 14542 - protein, 289 aa, Actinoplanes utahensis
MKVFLTGATGHIGSAVLPALLAAGHTVTALVRSPEKAAPGAEVVVGEIQDHEGVRRWAAAADAVIATASPGDASSSTVETAFAEAVLDGLRPGATFLRTGGVWVHGSAPDITEDTPRNAPDLVAWREKLDSRVLAAPGIRSILIEPGLVYGNHAGIPNVVFAGERAGDPPALRLVGPGTQHWTSIHVDDLAELYVAALDRAASGSVYLGVSGDNPTVRELGEAASRRLGLDGRVVAEEPAALVERLGGFGAALLLDQQATGAKARRELGWKPSRRTLLEEIAAGGYDPA

SEQ ID NO: 14543 - protein, 248 aa, Actinoplanes utahensis
MIGNWVDGVERVAVLTGAGISTDSGIPDYRGPAGVWTLDPALEKAFTYRSFLADPAARAAFWRAYRGHPAWRARPNVAHRALAGLERCGVAVRVLTQNIDGLQQRAGSSPRKVLELHGSMHEVVCTGCGVRTPSGPTMARVEAGDTDPRCTACGAVLKLAIVFFGEHLDPDTTGLAERIAANAQLMLVVGSSLRVEPVASLCAVAANAGHRVVIVNRDPTPYDDLAVEVIREPIGTALPEICAALRGA

SEQ ID NO: 14544 - protein, 61 aa, Actinoplanes utahensis
MGCRPAPGFPGTGLPPIGSPADRVFSPIAAKSSAAGHRAGIAAAGSPSATSASAGAAIDGH

SEQ ID NO: 14545 - protein, 305 aa, Actinoplanes utahensis
MVGVGNNTSALVQGINFYRATGSLTGLCRPHIEGLGVGDVEVVAAFAMSDAKVGADLHDAIFAPPNNFPRIGGELPPSGVTVQRGLTGADGIERIAEAVRGAEVVLYSAPSGRAGVALAYAEAALAAKAAFVNTTADPVARHPELLHRFSAAGVPLIGDDLASQFGTSVLHHALLRLLDERGLTLDSSYQVNLGGTEDFRNLVDNPESKLRSKTNGIGTGRVAIAPLGYLPHLGAEKVAHLNIEARGWAGTSVSVDVRLKVNDPSGAAGVNIDLVRLAALVSRRGRGGFPAEAAGLLKSPPGTAV

SEQ ID NO: 14546 - protein, 230 aa, Actinoplanes utahensis
MPKAVVSEDRRRRRRPTRSGRVLSEQLIIDTALRLLREHGSAALSARRLGLALDCDPSTLYRYFRGMDDLTLAIGDTLIGQALEGWRPTGQWRPDLRRLGLRIHAAYVAHPQAAVLTTSRVTGRANELAADEAVLGVLRTAGLPVPEAVRAYHVFIDQTLAFAALDAASLALPNAALRAEDEVWRSTYGHVPAASHPHLAEAGPLLATEMVTSAYPSALDLLLDAVEARL

SEQ ID NO: 14547 - protein, 415 aa, Actinoplanes utahensis
MRVLLVGAGGVGTAITRIAARRTFFDEMVVADYDLGRAEAAVGSVGDPRFRAARVDASDRAAVVELLDRTGCDVLLNATDPRFVLSLFEAAQDAGITYLDMAMSLSRPHPEAPYSKTGVKLGDAQFAEHPTWASKGALALVGMGVEPGLSDVFARYAADELFDEIDEIGVRDGGNLTVDGYDFAPSFNIWTTIEECLNPPVVWEAGRGWFTTPPFSEPEVFDFPEGIGPVQCVNVEHEEVLLIPRWVGARRVTFKYGLGEDFIRTLRTLHQIGLDSTDGVIVPGPNGPVTVSPRDVVAASLPDPATLGDRMRGKTCAGTWVRGVKDGEPREVYLYHVVDNEWSMAEYGSQAVVWQTAINPVVACELLATGAWTGAGVLGPEAFPPRPFLDLLTEYGSPWGLREQAVSAPVGATVH

SEQ ID NO: 14548 - protein, 388 aa, Actinoplanes utahensis
MRRRSLADVFSRRYDEFFRDRTPIPFEILTRDGATLAYGAGGSTPAEFRIVVRDDTGHDALASLDQLQVALAYLRGDIDIEGDLAAALTMRRFFSDIHPVAFVGRWAPSLWHGKAGHDRRAISQHYDEESDFFLTFLDERHRCYTQGVFHGDDEPLEDAVTRKLDIALDDIGVKPGDRVLEVGGGWGAFSEHAARRGIDVTTVTLAVESERFLKDLFERERLPVTVVREHILQFRSDQRYDAIVNMGVTEHLPDYGATLKTYARLLKPGGRVYLDALAMRRKHTASTFFKQYVYPGRSAPLLLHQYLQQVARSPFDLLSVQDDRHNYYLTCREWAKRLDARREEIVARWGEELYRRFRIFLWGSASGFDTRLVQAYRWTLQYNPSATA

SEQ ID NO: 14549 - protein, 223 aa, Actinoplanes utahensis
MPGATGLPLAPFLASRADNYDGLRLVRPSFVPELVLHLADDAIVLEARLEAQAGTSYHPFWTNAWAGGQALARYVLDHPRLVAGRRVLDVACGGGVAAIAAAKAGAASVTGNDIDPYACAAAAMNADANRVRLATVEGDLLGGDAGDAEVVLVGDAFYDSALADRMGAFLRRAADRGAEILVGDPGRGHVPAWLRELTTYRISGLGAAQDAAITEVSVLGVLR

SEQ ID NO: 14550 - protein, 67 aa, Actinoplanes utahensis
MATGTVKWFNSDKGFGFITQDDGGPDVFAHFSAIATSGFRSLEENQRVEFQVTQGTKGLQAENIRPL

SEQ ID NO: 14551 - protein, 449 aa, Actinoplanes utahensis
MDRPLRVAVIGAGPAGIYAADHLIKANPDVTVDILDKLPTPYGLIRYGVAPDHPRIKEIITALFRIMDNPRIRFIGNVAYGIDVKPEELNRFYDATIIATGAEKDRSLDIPGIDLQGSYGAADFASWYNGHPDVPRDWPLEAREVAVIGAGNVAIDVARILAKTADELLVTEIPDNVYQALERSPVTDVHLFSRRGPAQVKFTPQELRELDHSPNVEVIVHPEGIEFDEGSLEAMRQTRHVKMCVDILQNWAVRDPRDRPRRLHLYFLQAPVEVLGEDGRVVGLRTETQELTGDGWVRGTGEFTDWNVQAVYRAVGYLSSALPDLPFDTKTGTIPHAAGRVLDLDGDHIPGMYVTGWIKRGPVGLIGHTKGDAGETVASLLADLDSLPAAPQHDPAEVVAYLEQRGLPYTTWAGWQRLDAHEIALGEPHGRKRIKVVARDEMTGICNNS

SEQ ID NO: 14552 - protein, 149 aa, Actinoplanes utahensis
MANTERVLDVLIVDDDDADTLMIEEALLDVEPAPAVHRVSDGSEAIDYLRRQGPYADARRPDLILLDLNMPRMGGHEVLAEVKNDEALKSIPVVVLTTSNALPDITASYARHANAFVTKPMDLDGFEAAVRKIRKFYGETAVLPGDKES

SEQ ID NO: 14553 - protein, 215 aa, Actinoplanes utahensis
MRPGIDIPDARGRTGLDRIGRDLTGNPDVVVRDVEVLATAWHVLRRTTYDYRRSDGTWSREQRETYDRGDGATVLLYDDERETVLLTRQFRYPVYVSGHPDGMFLETAAGLLDGDDPAAAIRREAAEELGVAIGELERVFAVWTSPGSVTERLHCFAAPYTAASRVGPGGGLADDGEDIAAVELALGQALEMIGTGEIADAKTILLLQWFALRKR

SEQ ID NO: 14554 - protein, 252 aa, Actinoplanes utahensis
MLAAERRDVLLHRLRTDGKVVAKEVAAALGVPEDTIRRDLRELAAAGLCQRVYGGALPVSPALADYATRTTLATLSKQRVAAAAAALIRPGSTILLDGGTTALAVTAALPADLRATIVTHSPTVAAALVAHPAVDVHVLGGRLFKHSAVTCGAATVAAALAVTADIFLLGVTGVHEAAGLTTGDPDEAALKRILASRAAETYVLASSEKIGAASPFTVLPTSAVGGIITDAAASHPTLQALRAAEVAILAAP

SEQ ID NO: 14555 - protein, 439 aa, Actinoplanes utahensis
MPPRRSRCCPRRRSAASSPTPRRPTPPCRPSGPPRWPSSPHREAILPTRRPRRHRNGLDADPSPDCGTSCRRLENAVHGAREAVSGRGGGRSACRDAARCGREVVTGPGNRPTLCWRGPMMGAGLARTTVQDVARAAGVSVSTVSRALSGGTVSAETRENVIEVAARLDYRVNRAARGLITGRTGNIGLIVPDLRNPFFADVAKGVSARARAADCGVFITDTDEDPVAELEAIATLGRNTDGLLLCSPRAADADVLAGADPATTVVLHRRIAGMNAVVADIGDGIRQALVHLQALGHRHIAYAEGPAGSWAARERVAALSGAKSLGRVAPTFEGGLLAADLLLATTATAVIAYNDLVALGVLHRLAARGVSVPGQLSVVGFDDVSLATMSHPPLTSVAVPKDRAGAIGLDLLLGRSGVGGDVVLPTSLVVRASSGVVPT

SEQ ID NO: 14556 - protein, 377 aa, Actinoplanes utahensis
MVGACSSHPDPAPPAFVAAPGASGSALPESAPVLVAPSAAVSPSPSTAVKGSTLPKPGNPAGRAAVPAAAKAVDTSRPDRTIGSGTPASCTSAAVVAAVAAGGIVTFNCGPAPVTITMTATAKVKNAHTALVLDGGDKVTLSGGGKRRILYMNTCDRAQGWTTSHCQDQDTPRLTVQNMAFTGGNSTGDRTEGGGGGAIFVRGGHLKVVNSRFTGNRCDRTGPDLGGAAIRVLDQGGDTPVYVVGSTFTGGVCSNGSALSSIGVSWTVLNSWFSGNAAVGKGANPARSGTPGGGSGGAIYNDGDRMTLTIDGTVIENNRAAEGGGAVFFVSNDRTGTVVIRNSRLHGNPSAGFETTGLPGIFYLGSGNPKISGSKLS

SEQ ID NO: 14557 - protein, 484 aa, Actinoplanes utahensis
MITAMVPDIVRRRLSTLDTRIDPYSWLVTGVITVVAGILRLTGITQPRKLVFDEIYYPTDAWDMLTHGVEWDEKSDSAGYVVHPPLGKWLIAAGEKVLGNTELGWRLPTALAGTLMVLLLIRIAYRMFHSMVLAGAAGLLMTLDGFQLVLSRTSLLDIFLGLFILATFGAMVIDRDHYRRAQLRALETGSFRYTPWWLLATGVLYGLACAVKWSALFFLPAFALLIVVWRVQARRSAGRTSPIRRGIAGDLGWGVFSFALAFGTYLASWTGWLVTDDGFYRHWRAANGMGEPPFLGALLNLWHYHSEAYGFHSNLTTPHPYQSWPWQWLLLGRPVAFDWTTPAGCGAPSCAREILLLGTPLLWWSFLPALIALIWLAVARRDWRAYAILAVTAAGLLPWFWFAATDHRTMFSFYVMPALPFLILAVVYVLGAIVAAQRAAGIALAAAYVVLVAVCFAYFWPIFTDQPIPYDSWSDRMWLGNRWI

SEQ ID NO: 14558 - protein, 237 aa, Actinoplanes utahensis
MPGTTVRWVVVCTAGLTVLSGCSPSGDAPPRPVSGGATAGSSAAGGSAAAKAVDAACTRAAKVLIVRTAAGEAFSPARLTIRRGAFLAFVNRTTAAHPLRSAPDAGMVTSVVDADERQVVQFPKAGTFTVHGGGAALRLTVAGESGCGAPEPALTITAAGRFTPAAAEVAATGNFAVVNRSGAPQALRCTPGANNDHTRLEAGETQILALDEPGRYRCASVEHPAASVTITVTAPAR

SEQ ID NO: 14559 - protein, 512 aa, Actinoplanes utahensis
MAEAVALHEVALLLRAGDDVAVATRDLTAGETFHHAGAALIAVTAVPRGHKIALRGLAAGTQVHKYGQVIGRATEAIRAGEHVHAHNLGMDAVEHDYEFATAVAALPGASSVRTFEGFERAGGTVGTRNFVGIVTSVNCSASTARMIADQFRGPVMDAWPHVDGVVALSHDSGCGMVPASEGGRILRRTLRGYATHPNIGGLIVLGLGCEMLGVETLLSELDAPADTLIERLTIQETGGIRATVRAGAGVVREMLDRLDQRRRTTVPASKLILGLNCGGSDGYSGITANPALGHASDLLVAQGATSVLAETPEVFGAEHLLTRRAVSRAVGQRLLDRIAWWHTYVEAGGGTLDNNPSPGNKAGGLTTILEKSLGAVAKGGAAPLSAVYEYAERISGPGFAFMDTPGYDPVSVTGLVAGGATVVCFTTGRGSVLGGKPAPVIKIATNSETFERMRDDMDLDTGGIVTGTTSIEAAGAEIFETILAVASGRPTAGEDLDLGRDEFVPWQLGAVT

SEQ ID NO: 14560 - protein, 1251 aa, Actinoplanes utahensis
MSGVLIGIGLSALSNAIADAFAATGAYQHNRRDPERVALSAVAARALSAAFADARRADLTASPEWISAVAAEWRPAFSPDVVARLMSVIATPSAANQHRFTEVIRTALTDVGFDLALLEQTLSVERFAEALPRHLWPELKRAAIAGAALRDLVQQLLSQRAEYRESAQDASEPREHRHDMLTYLRETLRDARGAVPAFLPDDRSANLHQRVRVRLKTRVAGRNADPDGDRAYQPPVEYAGLDEHAPAAERSWDEVRTCADRIVVLADPGLGKSWLVRTETIRLAMAALAALDEDHAAVIPVPIRADALAEGLRWSIGEAAARHFAARGRLAERSRAYFAEQVDAGTVHLLIDGLDELPDAATRQRLRAALSDWSRRPGVRRWLVTSRIAGYTGLDTRDTEEIELLGLTTGQVETYVRAWGLPEALRDRLLKAVADPAVSGMARIPLLLALLCSLAGADQDIPRTRVELYGRILRWFLQRPHRGADRSDRENQTLLDLVQEVATHFANRDAGWADLMPHDALTRVIRQSPRLGDLACTPDRLIEQLSVELGLIVPEGDTSRGRRARYLFAHRTFAEYLVACHLATLDEQDRWAIIERHLWFDPEWLQVISMLGGLLDDGGTRRLVERLCRVDDDVLRQGWLMAVRVVSEHPEADGVLTAESRRSLRRTLAAVVRHPYLRWSAVTALRGVPVLTPAAAAELLALTEADDPDVRHAAVQSVASVEDPSPVAHLLARLDDEDEHVAAEAAKSLAGRHSPGVLDALLARAGADRRRVALACTESLRALPEAVRIAAVRPLLAAGRPTAVRAAGCAVLRGAGPAAADLILAGLADEDIDVRAAAAQAVTGPLDPRVEAALLRRLEAYLTESAAGADLTVWTGDTGYRSDLDAQAARAALDRCASQAPGFTAAFLRQVVDRGDSVDRFGRDTGPTAPTADLVDELVLRLSDGGARAGRAARLLRAMRPDGIDDALLRLLDTGSPAVVAEVLTAARGRRDERLPHRAAELLAHPDETVRRAALELVIDADPPGLEDLLLRGLRDESLRIRHLAAGGCAGRHDDRLVSALLERVRDPDEGADVVGPAISALGDREEPGVREALLACLRGETGGEPRPRPMLYPGRAVDVTAAAVLAVAEPETVLSEMTARAGITDGYRGREVAGALRRCPAPGTVEFLVRMRREGARKTRIAAHNALLARPYPEDLVTLVDLLDGMPPEMRQDMVVVAAALAARHYRKLADADRRRVRGRLTAAVAAAAG

SEQ ID NO: 14561 - protein, 172 aa, Actinoplanes utahensis
MPRALLTYGGPAVVVGLVAAAVGSALLVRDDRDRHPAECGPDPATVQAIGGESILRHHPEASHLNELSPDGYQCGDSPMAAVSRSLIGPLSRSEVVRYYGRLAEASGWRRFDGSRQIYSASKTTAGGCPWWFVISPGQNEYHLQVFYLPAGIPQDRCVWKSQEPLLLGLPPK

SEQ ID NO: 14562 - protein, 202 aa, Actinoplanes utahensis
MSQVAPRRVPARADAWRPQDEVLNGLIHKCIEQAYRRNAETGSMAAFFGGVIVLIILGVIMSTGTGNPLLAIVVVVLLAGSGLMYAGMNAPAPKVDPIRILDVLGGPGNLPAGYLVYPAAWRAGMPEFLNKVSDRQVAVAARLCREHPGSVADLIRLVATAEQHAHEHAYGRSVTEGDIYRYAHRATVEWARLAPAPMMAAH

SEQ ID NO: 14563 - protein, 230 aa, Actinoplanes utahensis
MRWLRGIGKRRIPQDPAQQQVMLRELRQRFGPHAGRRFAAQSEQAAALLAGPDGLVVAATVLREFADAAFADVAQQAAALGLTPDRRNYRPVWEAAGKRLRSPLFTGLAGFHPYVHVAAAVSVVGGQAAQTVRLVDPLPLLTHMFEVLDLTLAGWEFGRVLVDVDGATLAVNLIQGATAIRGEMSDPPPLPQPARTQMRSNRSVNVLDPTVSRIVGQWNPGKQMRECLLA

SEQ ID NO: 14564 - protein, 59 aa, Actinoplanes utahensis
MSFLDKAKDFLDKHDEQVDKLLDKAGEQVDRRTGGKYSDQIDKAVDEAQRRTGAGDTQP

SEQ ID NO: 14565 - protein, 255 aa, Actinoplanes utahensis
MHPLADRLRAALTAGRSVTLSAGDVPLFTYSYGAAQPELRDLRTLDGAALPSAVTWTPPHAAPGAATHVAITDLSSSDDSATVAHHLRWPAFDEWRSLTASLSGAGAWTLLFENTVTNVSGRRLLLDGRSLAMPTLAAPAAAPTAWHAAHGDDFTLVAVDDAANLQHPPRWSAGLSPAPFGATGVVVGVDRTIAFRYALVIAPPGPPPDALAGLGLNALAGPSVARPHRCHGDHSRATPTRKARGRALTRRRDTH

SEQ ID NO: 14566 - protein, 99 aa, Actinoplanes utahensis
MTTALTLTTGQQPDGAPLLAAAGEIDMSNADTFAAALSASAPAAGRPLLVDLTAVEYLDSAGLAALFRHADRIEVVTGPLLAPLLAVSGLGDLTTVHSR

SEQ ID NO: 14567 - protein, 1346 aa, Actinoplanes utahensis
MSDVFAADAEVGRDLAAVDWAATPLGPPDAWPQSLRTAVSILLSSRFSMWMAWGPELTFFCNAAYRRDTLARKYPWALGRSAREVWAEIWPDIGPRIQNVLDTGQATWDEDLLLFLERSGYPEESYHTFSYSPLRDDAGALVGMLCVVSEETDRVIAERRMATLRDLGSDPSVIRTEQETLAFAARQLDRNRRDLPFTLTYLYDEAGRAHLRAATGIEPGHPAAPETVEADHPYAGATESRLVPLTGAGLPTGDWTAPPEQALVVPLQPFGFMVTALNRYRPIDEPYRGFVELAAGHVAAGIGSARSYQAQQRRAEELAELDRAKTTFFSNISHEFRTPLTLIMGPVDELRTRLAGADQPIRDELDVIHRNGLRLGKLVTALLDFSRLEAGRMQARFEPVDLAATTGELASVFRSAIERAGLRFEVDCPPLPEPVLLDRGMWEKVILNLLSNALKFTFEGAIRVTVAAGDDAAVITVADTGIGVAPEEMPRLFERFHRIGTARSRSNEGSGIGLALVKELVGLHRGTVTADSEPGGGTTFTIRLPFGAAHLPADAVVASGSAAAPSTTVEPFLQEANRWLPGDPPPEETPITRLDGATADVLVADDNADMRDYLTRLLRSAGHRVTAVGDGRQALDAIRTDAPDLVVSDVMMPRMTGLELVTALRADNRTAGVPVLLLSARAGEEASIEGLEAGADDYLFKPFSAAELLARVRANVELARLRNHHARWRTALVDSLQEAFFVCDEDGAVIEINTAFTDMIGFGPEDLPYAPVHPWWPDRESDPEAYAEVADAFHLLMQAHQGEYTVPVKHRDGHRLWVAASFNHVRDPESGRRVIVGTFRDVTDEHYAIQRETALAALSMRLSGADDLSDALTGALDELRGLWQASVVLGAVFTGDATPALTTTDPAVTWAGAPQDRIVALRDGPPLTAVATPTEGAGIALEHPDGTLVVWIGLGPRRPFTEQDETLLALLAGHLGQGLRRVHQIDQQRETALALQRAILGPAQLPAGFAVRYEPATRPLKVGGDWYDTVPLPDGRIGIVVGDCVGHGLRAATVMGQLRSACRALLLQDSRPARALEALDRFAALLPGASCATVFCGVLDPANGHLTYSAAGHPPPIVALADGTVELLDGGRARPIGIRPQDERREAEYAMTPRSTLLLYTDGLVERRRQPLTAGIERVADAVRTGRRTPVEELATEVMERLAPAGGYDDDVALLLYRQPGPLEIEFPAESSRLAPIRSALRGWLDRCGIDPVTAQNVLVAAGEACANAIEHGHRDLTGGLIRLRAAVTADALRLIVSDTGRWRVPQPDDNPHRGRGIMLMRAFMGEVTITTGTAGTIIDMQTRIV

SEQ ID NO: 14568 - protein, 506 aa, Actinoplanes utahensis
MSELIDARLVSGTDPNGGSGEATKGTQQDIYFFTSIEDFPPGVGDLSLTHDDAQGFYDYVKQFNTPNGWYRDASVGQWIYEETYDNYLDDYGFDAAKVVYHSGHGGMASNGVFSIPVGNDWGGDHWTSSNDMRLGNEYARYVFWSTCESVRVKGGQSPIRTWQTANLGLRMIFGYETVSVDNGDYGRFFFQEWNKNKSFSTAFLDASWRISHGQEPAVTACGATQAEATDRLFNERLFDAGRASTTWWWWRWYDRASLRARSLDVPAGVRSAKFAAASARDLAGAWTDRFGGEARLVLGANGAREVTLAGTAVSDARLTDEQAVAAARQAIERYRLAEHADLALDHIRYDRHAGASADEQVDEQVRERSVGFVQLIDGVPVVSPDGGRLHVRVDNEGTVTGIADSTRPVADLRDASAAPPRPVPRQRTGVDAVSNLDELFGESLQRRLRRAAAGGRVPSAVRVVPDSTEVGYAVHGDGAVLVARREVEVDFGGGLAKRYVLEEPVS

SEQ ID NO: 14569 - protein, 727 aa, Actinoplanes utahensis
MRLVPRLLYATLATVVLAVIGTPGTASAAITGTTIAAPGGTCVDVSGDDTGVNGTAVQLWACQSTSADQHWTWSGTALTTIGRCLDITGGGTANGTALQLWDCNGTGAQQWTPQADGSLKNPQSGRCMDAPGGATANGTRLQIWDCNGTGAQKFTVGTPNPGTCPTYSDTPDLGANVHIYDHSMTDAAIQASLDSVFNAQKDTNTAQFGTRRDALVFKPSTTPYNVGANIGFNTSILGLGQNPDDVRINGAVTVDAFNAGDAGNATQNFWRSAENLSVNTNGGTNRWAVAQAAPYRRMHVIGGLNLFPASYGWASGGYISDTKVDGTVESASQQQWYTKDSTLGSWSGSNWNMVFSGTNGAPATHFTTDPASGPRYTTLATTPVSRDVPYLYLDAAGRYRVFLPSLRTNASGPSWAGGSTPGSSLPMSNFYVAKPTDSAATINAALANGCNLFFTPGVYHVNQTLHVTRAGTVVLGIGYPTIIPDNGVTAMDVADVDGVRLKGLLFDAGTTTSDTLLKVGPAKSGVAHAGNPTTVQDVFFRIGGMAAGKATNSLVVNTNDTIVDHTWAWRADHGQGIGWTVNTADSGLLVNGDNVLATGLFVEHYQKNEVVWNGANGKIVFFQNEMPYDPPNQAAWMNGSQNGYPAIKVANGVTTFEAWGLGSYCFFNVNNAVASAHSFEVPAVAGVRFHDMAAVSLGGVGTISHIINNTGAAANSANNNSYLVSFP

SEQ ID NO: 14570 - protein, 136 aa, Actinoplanes utahensis
MSDTKPTVLFVCVHNAGRSQMAAGWLRHLAGDRVEVRSAGSAPAGTINPAAVEAMNEVGIDITDQTPTKLTWDAARESDVIVTMGCGDACPVFPGKRYEDWKLDDPAGKGVTAVRPIRDEIKTRVEALLTDLFPAA

SEQ ID NO: 14571 - protein, 243 aa, Actinoplanes utahensis
MPSLAPWRRLLAEFLGTALLVTAIVGSGIMASRLSPGDVGLQLLENSVATAFALAALILTFGPISGAHFNPVVSAADWWLGRRTRTGISGADLAGYTIAQILGAIGGSILANLMFDLAPVTFSARSRAAGHLWLGEVVATTGLLLLIFALGRSGRAAVAPAAVGAYIGAAYWFTSSTSFANPAVTIGRAFTDTFAGIAPASVPGFVTFQLVGLLVGVGLLLALYPDAGRAADDIVVDHPATAP

SEQ ID NO: 14572 - protein, 161 aa, Actinoplanes utahensis
MKAESDGGFVELITRIRNVSNPMTVEAKVARGFDICQPRPMSKPPVVSVAPQTPCCTPMAQQRIPAPAAATLAQAFKALGDPIRLQLMSMIASAPGGEICVCDLTPAFTISGTTISHHLKVLREAGLIDGERRASWVYYRPRPELMRQLSTLLSVDESVPA

SEQ ID NO: 14573 - protein, 441 aa, Actinoplanes utahensis
MQLQPGRRERRPLRLVKHPAGSSVPADRRAGGHRRSSPPGNRTLVPALAITQTIGYGTLYYAFVVFLVPIAADLHTSTTAVTGAFTASVLTSAVLAVPLGRRLDRHGGRTLMTCGSLLGTMLLVGWSHVGQVWQLYAVQIGIGVASAASLYEAAFAVIIAWCRPERRSRALLTLTAVAGFASTIFLPLTGWLTDQHGWRTTLLILAGIHAITAPLHAATVRRPPAATNLVTRHRDVDASVVRAALADRAFWVLTAGFTTHAMAISAYTVLLVAALTTWGHPPAFAATIAGLLGVLSVTGRLITTSLQSRYRTTTITAGIFAIQAAAALLLPAVGASTGGAIVAVVGFGLGFGVATIAKPVILAERYDTRRYATLAGVLVAPMTLAKAGAPLGAATLHRTTGGYTSVFTAIAVCCAVAAAAIGVCFPGPRDHDIGGDGVHDE

SEQ ID NO: 14574 - protein, 225 aa, Actinoplanes utahensis
MRARLLTTASILVVVGGCGTAPGAVKPAGLTPAASPRVSTSVPVSPGVSTGWEITVYYTAVQRFHTGAPTRVTGCDRLDCSNGKDDLGSYPADFVQAVKDEGTGQTADGHYLNWSYDVGYWLDSEPRDTDGDRLRPFVSAAADPNVLPHGTRFTIEDCGSQDDGSAPQEAVCAALRDGAWEVTDEFTPGLGGSKHIDAYIGPETGAGFTGSDWYITLTRARISIG

SEQ ID NO: 14575 - protein, 351 aa, Actinoplanes utahensis
MAMTDVIFGLDTFGDVPQDDAGAPLSQAAALRRVVDEAVLADQLGVDVIALGEHHRPEYSITSPETVLAAIAGRTERIRLASGVTVLSSDDPVRVFQRFATLDAVSGGRAQAILGRGSFTESFPLFGYDLSDYDVLFEEKLELFVQLLDEKPVTWSGTTRAPLVDADVFPRTESGRLDTWVGVGGSPQSVVRTARHGLPLMLAIIGGPPDRFAPFVDLYRRATAQLGTVAHPVGMHSPGFLADTDEQARELFYPHYRVQRDRIGASRGWPPLRRAEFEAEIEDGSLYVGSPDTVARKISRAIRALDVGRFDLVYTVGAQPVGARLRAVELFGAKVIPMVRDMLTGSGPLAT

SEQ ID NO: 14576 - protein, 257 aa, Actinoplanes utahensis
MAAVRRCRPRRSLRHDRYMSEFPAGDTARARLLDQRALHASSVGANNAMNRDRRLTGVNSYARVLGFDPVGHLTGPDPAWLDLCCGSGRALLQAAGRLRGAATLIGVDLVDAFAGAADGVTFVAAPLEDWAPDRAFDLITCVHGLHYVGDKLGMLVRVARWLAPGGRFVADLDLGGVRLADGRPAGRRLVGRLRQAGFDYDGRRRRISCTGPRKWEIPGEYLGADDRAGANYTGQPAVDSYYRFAGRGPTGINVSTG

SEQ ID NO: 14577 - protein, 259 aa, Actinoplanes utahensis
MPIEQSATHPVEWWQQFQTATERFDEAILTTGLTELLLPKIVSQLLQREADIASDIAIAYRNRPGSEGLRDRYDKAAARLRETIERLADRDVDRATLLEAEAVSWVIGGDYARAAAEIEPRVGAVVLLRIFVSALRVAQLDVNVTANLLNAGRTPTEAIHAGRLLGRYGYWPEWLRDLVVEHALAGTLNDDFVAALDMCAFATLRSTQARFARSLLRGEPAAITTAARTLETIGETEIAARLRQGDMKAVAFAARFAAV

SEQ ID NO: 14578 - protein, 245 aa, Actinoplanes utahensis
MGNPLGSAGNDGRPGMRDRSSAVGRCGSTPTPTPTPIAAATRPTTPATSSVRQDLRLSMSIAPHSPLLPETGTQVPDHTGHRRITLSHAGIPARRRDLATDMTTDFDPHALIAGSRLGILATLRRDGRPQLSPILPFYDRDAGTIFVSMTEGRAKTANLRRDPRGSISVTSADGRSWATADGVATLIGPGTDPHGPEVEALVDYFRRAAGEHPDWAQYRRVMVDDRRVLLALRVTHVYGQAITAD

SEQ ID NO: 14579 - protein, 427 aa, Actinoplanes utahensis
MTTRLRRRLMWCAGTLGVSGFLLLIAPTPAYAACAPSYQEVPGQPPAGDASCGGDAAAAAGVVLLLAGAVGSVAVPLARAAGLQAGGDPPMSGPETASELAHVLEGTAEPPPTVQLNRSGDPYDSRTGRFVTKETDGRLRKAAPVRVTAYPRPADFPMMDRAVDRYAVADGARTATYTRPLPAANGETLEGLGPKLEAILRAAEPDFKVDKTAYSSGRRYEMLKQAARQLFNNGDYRTPNRAFAAFLEAADLFREQLQPLSEAGTALGVAGEEWVVAQVLKVPPITVSGTGTAKSREFDSVIVSDWPEEWGATSAGPVLILCESKGPTPGLGAAKVRLPDGTWTRAQQGEVHYLGRTLAVDAKLATALDAVPGRRELIQRLVDARAIRYIKVRTLETGRIVVHEFTLDPDVLRSLVLKLPETAESPS

SEQ ID NO: 14580 - protein, 171 aa, Actinoplanes utahensis
MSFTRTDDAAVRDLLTALRDVPWHWRLDELDDLAARLGWQITDRWDKGAEFTVGWPLPSRGALLTFWKGGGRQMDFDLTARTDDTPETDAAADDAFADFAAIATDVLGRPDRTTPGIHPSVAWRTADSTFELAVFLGTVTLTWSSNAYQQFLRDTTVADPADDGDGDGDDE

SEQ ID NO: 14581 - protein, 143 aa, Actinoplanes utahensis
MTADPWTALADRLARLLTRREADDFLILHAGPYYVQCYQGPAELYAEALANRSDFPPVRLPAAAEQRLRDLGWQPPDGPDENWTTRLPFPASHRQARALADRMLTTLREVYQVGTITDLRYEATNARAGTPWNAAPLGLLPAG

SEQ ID NO: 14582 - protein, 363 aa, Actinoplanes utahensis
MVSSPPRSWSSHSSSRRCSRSRSSSATPAALLRATSAARPSTNDRRSSISTIMRSLSGGRCGKITVVNLADVTDRGSVVRLNGVDLFVRRFGDRDLPPLVVIHGGPTWDHSYLLPAAADLADTAHVVLFDLRGCGRSQRTAPIGDLPDGALQPPRLADDVAALIEALGSGPADVLGFSWGGRIAMRVVEQHPGVVRRLVLASTTAYTDFDDELAASADYRARRRLCTAVGFDDPLVTGPDGALSRAMAYGDAPLQVWRLDRLDDWHRVLAAVRFTSDYNRLYTSGALLPGGPDDAEAVLRDWGGPVLILHGAREMGFPVGVARRLHAALPASTLVEVPEAAHMAHFDNPGVWLAGIRDFLRAT

SEQ ID NO: 14583 - protein, 164 aa, Actinoplanes utahensis
MYVIRERFFAIGDDFDVLDENGAKVYRVDGKVLSLRNKVVIEDPAGDEVATVHRHLVSLRPTYEIRIGGEKAAEVRKKLFTPFRDRFTIDVPGPDDLEMKGDLLDHEYVIEQGGEEVAAVSKRWLTIRDTYAVRVAAGIDPLLIIGSALALDLALERGVQDDED

SEQ ID NO: 14584 - protein, 550 aa, Actinoplanes utahensis
MAVARSMSQGMEASATPAGAAARGAALDRALTTLEEQPRYGMNLDEWISRAIDLEAAADRLGRADLALRAQLVRADIVGRRGDVISSGRICRHVHRWAVEHGDQRLLALSHLRLSPYFGQLGDYPTALEHALGANRATSALGGAASAYLRWRCAMALADALADVGDLDGARARYAEAARVSVILGDIRARIRVFNNLAYTEFQAGGTDAAQEAVERLLRLAADHELTLDYNTLDTVASVQLAAGRYADAIATLQPALDDAFAAAYEEAGSRAQGLVTLCQVYRLAGDLTSAQDAIDRCRALCESRGLSGVAVDVRREQAEIWAAAGRFAEALDEYKLFHAAAMALNSGERDARAQTLHAMYEADEARRAGARARELSLRDPLTGLFNRRFVDAELPVLLAQAIETRTPLSVALIDLDHFKRINDTCSHEAGDRVLRMVADLLTGVAGLAREAFAARLGGEEFLLVLPGAAAGSAFAWAERLREAVRGHDWAPVTGDLPVTASIGVATVAPDRDTQEALLRQADVHLYAAKEAGRDRTADGSATMPARQAS

SEQ ID NO: 14585 - protein, 399 aa, Actinoplanes utahensis
MTPASPIVRALTLSIAASSLAKGVLFAVSALFFTSVLGLSPATVGLGLTLAGGCGMAAAFGAGWLADRAGAHRVLAAATLVQGVALAAYCRAGNPMSFFVVAAAAVGAQGAQRTAQATLVALHCTGPERITVRARLRVVTNVFVGLGSAAATAALADGTATGYRIAMLAASALVLASIMPLRGLPPRRAASTSRPSMRTPLKDGRYVVIAALYGLLTVQFGLLTVGMPLWVTGHTRAPAATVALLLVLNTVLVAVFQVPAARLVTDVRTAGRTVLCSSVLLVLTCVFYAAAGPLPAAAAVGVLILAVLTASAAEVLSEAGAWSLAFELADPASPGGYQGVSQTGFAAGTMLAPLVVTGTGIAHGAPGWLLLAAMFLTAGVGTDRLAGVASGRLAGRHRG

SEQ ID NO: 14586 - protein, 329 aa, Actinoplanes utahensis
MAANDVAFRFMVVRYQLGGRDLGRVRFAVSPLHELVLSLHAWRDPGRYPLQLPWIREMRGAIDGLDAELLIQLVNDELWTPDFLTPRPWSPLTRLEDEWEVVRRTPAVVVDRELRALHGGLPAALRGDDVLARIVDALTGYWEICFAPHWPRMRALLEADVTYRGREIAQHGLARMLGGLAGRVRLTGDTVEVFPRAALDYTAPATDGLTLVPTMWTTSAAVPLRADRPPMISYLARGLGTLWEPQPLPAPGALAGLIGVPRAGLLVQLAVPASSTELAARLGVTVPAANQHLRALRAAGLLVSARHGRSVLYRRSDLGDRLVASSAAG

SEQ ID NO: 14587 - protein, 423 aa, Actinoplanes utahensis
MAHHHRTAGCRVDRGQDRGQLIGEGRRAVAVALTRQGDRHRVTAPGRQAGGDTGPRRRVEPETTEKHDLIRIHGGTVEGIPDDPLPVPSSTVLVVPTGPGPTARALRTLEILQARPGITAGRLAALLGVTDRAARRYVEILREAGIPVTSVRGPYGGYRLGRGTRLPPVVFTQEQALGLVMAVLDGQPAAIDADDLVGEALSRVIRALPGRVGEQAAALRAYASATPDRNAVRADPAITGELVAAVAERRRVLVGYRSERGREQETEVDPWAVVVRYGRWYLLCHSHRAAATRTLRIDRLFAVERLERGFIPPEGLDPVAALEANLGAGWKYPTCVRFHASLAEVAPWIRGPMGRLEADGDRCVLIGTTRNPAMYAQEWLAAIPFDFTVEGGPELQAAVAAVAARFGAAVSPAAAPGENVGGS

SEQ ID NO: 14588 - protein, 108 aa, Actinoplanes utahensis
MQTPAMVGAARERARAAGFTMSSEDGCGRLLAGAVRRGGRWIDLDNTVAASTPGGVLLVDDLQPEQWGSADHERFTGEVAAALRGHPGLTAVEISWSSGVILCSRRGA

SEQ ID NO: 14589 - protein, 185 aa, Actinoplanes utahensis
MVGFEMDAGALSEDERAFVATTRSALSADVSGFVGRVGGRLLVGVSVVDRIPGRHPVTVLMIGVHYGDGQVLGGRLDHEDYALLGEARFEAGGPAGELGRAAGEWLADVLGRPVALYCWMRDGQAVACQYRFADTGEVLLRSGTPRPGAPDIVVPIRGDVSGIPLPVGAVLSGERPAVTGVWREG

SEQ ID NO: 14590 - protein, 275 aa, Actinoplanes utahensis
MGTRDAGMLSVGEVARRAGLTTKVLRNYDRLGLFVPRMVSADGYRWYAESQVATAVTIARLRALDVPLQAIRALLTGAGEQEARRLLTRHRAALQARADRIRRSLHSLDHLLDDERGITMAMTAPQPPTVTEERELARTLFNDTWSLIEKESRSPAEDDRMIHMAHASRFHWDNAGDDQNRAIGEWQCSRVYATLGRAEPALYHAQRCLTYADRPGAEMWLQASAHEALARAQAIAGDLPAARDSRARALALVDRISDPEDRKVVMADVDTLPIP

SEQ ID NO: 14591 - protein, 443 aa, Actinoplanes utahensis
MDERRYLAAAAVCAATLLAVTACGGGGRSATGDDGKPKTVPTTRGEGATLTVWVMDGDYTDATLKAINNQFTQATGARVDLQIQQWEGVTTKISTALSTTGTPDVLDLGNTQVPGFAANGGLLDLTPYAADLKQGHRWLAGLEEPATVDDHLYAVPGFAGARAVIYNKKTWAAAGVTAAPTTYAELTAALDKLGAANPAADFSPFYLPGQYWYAGMQFIWDAGGDIAGDEGGTWKGGFSSPAGQKGLADFKTFQNTYSSKASQALDTITPDQNQVFADGKTATILSTAGSIGLIQKDNPKIKAEDLGTFPLPGVSGRAQPVMLGGSDWGIATKSDAADLALQWVKIASSPSVQDRYVFGNDGWIPNSTEGIQAAQPGLKEQQKGFFTAALTSKATPAAAQWPTLEGDKSINQVFATVVSGARSPADAGREFDAHLESTLAGGK

SEQ ID NO: 14592 - protein, 326 aa, Actinoplanes utahensis
MTVVPVTTVLQDAAGATPAAPPPLAARPARRRRTLAPFWLLSPAGLVLAAVTLAPLGFLIFTSFTDYDQRTLFTGTYHFVGADQYAELLADPAFWTSLVRTVLFTVAMVAGSVLIGMGVSHLLTRLDRGWRHTVTVVLIVAWAMPNVASALVWNWLFQPGYGVLNWALGQARVFGDTTDLNWAQDPALAYTAIWLLIVWQAVPFIALTVNAAETQVPQEHLEAARLDGAGELAVYRIVTLNHLRPTLLLVTILSVIWDYNVFNQIWLFSRGGPGDDTATLGVFTYKTAFVGFHIGQGAAISVVTTALLLALTAVYIRGLLRSGEDL

SEQ ID NO: 14593 - protein, 275 aa, Actinoplanes utahensis
MSHRGRRIVTTLAAVFCLVWIFPVYWMVNTAFKPRSEVSTTTPHFVPMHPTLANFSRALGQDQFLTNLRNSVIVVAVTVLLSVVLGTFAAAALSRFRFAGRRTVMVVILAVQMLPGTALLIPMFAMFNSVDLLGTYLALILAYVATVLPFSIWVMRGFFVAVPAEVEEAAHLDGASTWRTLVSVLFPLVAPGVIASSIFAFIAAWNDYLFAYTFMQDQSRYTLPVWLASFSNPHTGTDFGGQMAASAVFSVPVVVFFLFIQRNLVAGMSAGAVKG

SEQ ID NO: 14594 - protein, 530 aa, Actinoplanes utahensis
MSADTEIPDSQAVLAAALDAYLAFDATGRVVAWNPAAETTFGYPRAQAVGRSIEELIVAPGAREAGRAELALLTSGQPGQTRNRRRQWSAWHADGHEIPIEMTLTATDSATGRLFHIFAHDITAEHRAGRFTAVEAAVARGLAEADSSDTAAERVVEALGVKMGWPVTELWVVDDDRQLLNCLARHVEPGRRLHNFAVDTLELGVALPGRVCAEGTPQWIPDLTADTGSLRSRAGARIGLRVAVGVPLCTGQHVFGALCVYGNRVEDPEDTLIALLSGLAAQIGQYVQRRRAEELTIELARTKDEFLAMVTHELRSPLAAITGTASLLDDEIDDLSPDERHHYLRMITRNAERLSVMAEDLLDLARLESGSLGISPVGTDLCEIIRQSLQAVTPADKDLTIVARLPERLDLYADPGRLRQVADNLLSNAVKYTPEGGTVTVTAAMDDSAETVTWTVADTGIGIPSAERPRLFRRFYRASTALDRRIPGTGLGLVIARAIVERHRGTITLADHSGPGTTFAIELPVKPAPG

SEQ ID NO: 14595 - protein, 722 aa, Actinoplanes utahensis
MPELDVAVLTSPQRLRAVASARRELPVLPVPLDGMARMAARMLRTPMAVVTLVQGGEEEFLGLFGLPEPFAATRRAALQFSLCAFVVCADDVVAVDDTLAEERLREHPVVRQWGVRSFAGIPLHDTDGQPVGAITVIDIAHRSWTAPDLTRLTYIADMLGPIPAGTPSAEAAMDLLCTDHRGTGPQPAAGVAAQAQVQQAFIEALLDSLQVGVVACDRDRRPVVVNRMMRHLFGLHDGISREEALTAGLARVHHLDGTPIAPDELVVTRALNGETVRDAASMLCTPGAPDRYLLVNGQPLHDHDGNRLGAVSTVLDITGRRRNERFRDCQLRVARILNSSDTVEQAAPRLLSAVGEALGWQHVGLWLIDDVADVARPAGHWEAPGVHIEDLIPQRLTRNDPGLVGTAWATGRPIWIADLATTTSTDPRLRDFIAAAVHRDLRTAVAIPICENDTALAVLVCLSALGEHDDAPLIGLLTDIAEQIGRLLARRRAAELDLQLASAKDDFLTLISHELRTPLTTVLACTSMLADDPQVDPDTRQMLATVTRSTTAVQRIIDELIDLAGIESGHHPLHKRATDLVTVVTGALAAAPHPDDIEIHTDLPPSLVVDGDPGRLRQIVDHLLSNAIKYSPRGGDVRISLSADRGDVAELAITDTGIGIPEADRAGLFTRFHRAGNARHTAVTGTGLGLALVRALVEAHGGTVTHDPAHHPGTRITVRLPR

SEQ ID NO: 14596 - protein, 232 aa, Actinoplanes utahensis
MTITFITGANRGLGRETARRLLELGHTVIVGARDPLLGAATAAALGARFVQIDVTDDASVAAAVAAVEQHEGSIDVLINNAGVHGPVGDPGALTAADMLGVFDVNLFGVVRTTTAFLPLLRRSPDPVIVNVSSAMGSLAATHDPARPEAGVVAPAYTSAKAALTMLTTQYAKGLPGIRINAADPGYTATDLNGNSGPQTVTEGTDAIVALATEGPGHGSGRFVDRHGEITWS

SEQ ID NO: 14597 - protein, 289 aa, Actinoplanes utahensis
MTTEGAGLGATIRAWRNRLSPAAAGLPARRARRTAGLRREELAELAGLSVDYVVRLEQGRATTPSSQVAAALARALQLSVAERDHLFRLSRLAPPADDRISDHIPPGVQRVATRLGDAATAIFAADWQLIWWNRGWAALLGDPAAVPPALRNFALDTFPTAPGATPRLSRWPVLSRDGDATKAAIVADLRGATGRFPRDRRLAHLIRDLTGGNPEFAELWASGAVGAHREDRKTVHHPTVGPVTVDCDVLSGGGTGLKIVIMTATPGSPDETKLRLAAVAGSQLEDSHR

SEQ ID NO: 14598 - protein, 206 aa, Actinoplanes utahensis
MYTYLDSVVDESPAPAAPYRTPVSAEPLKVYQKRPFLIGLGSVALAAVVTLSVLYTGALGDNGRLSDQNNGLVAQSTVLAQQKHATEQELASTQTQLTSTKDDLQTANDDLASTRSELKSAQAKLSSASSQIGDCQHAVTGLLTAGQTLAEAGKLTAEAMSYLIDGDYDTATPLIEEGTAKVRSATASIKSLKAEIGSCATSSSAA

SEQ ID NO: 14599 - protein, 277 aa, Actinoplanes utahensis
MRTVPLRSGTVEYDDSGGAGPVLVFLTGILVGATLWRHVVADLRADHRCVVLEVPLGAHRLPMNPDADLSSRGLAGLVAEFLDALDLRGVTLIGCDWGGAQLVAGYGLSSRLARLVLLPQESFDNFPPGLPGKALHQSSRIPGATFLALQTLRIRGLRRSPMNFGLMSKRPVPADIMDDWLRPSRTSRPIRRDLHRYLRTTRAAEYLDAAALLSTVDHPALVLWAPESRMMRAANGARLAEILPRGRLVEVPDAFTLIPEDQPTRCAAHLREFVATT

SEQ ID NO: 14600 - protein, 331 aa, Actinoplanes utahensis
MLDGNSLVHRAYHASDGSPEPAPALRGLVGYLARAAAQLRPDAVLVGFDCPHDSARRTDHPDYKAHRPAKPAELTRQLQIAPDLLRAAGVGTVVPPAYEADDVLASSAALARSLGWQSVLMTSDRDAFALIDDTTSVLRIRNGGFDRSVLVDAASLAAAYGVHPWQYTDFAALRGDPSDNLPGVRRFGARTAARLLTAFGSVDAAWQADVAALREAVGELAATALLEPAAREAVDRNRRLMRMRHDLPVPSLETARLPLDYLVIRRALREHGINLGPSLWALVGGDAPAPSLLEQEPPEPPPAWAATLKPRVLHGSMSGRRDPIPGQTALF

SEQ ID NO: 14601 - protein, 265 aa, Actinoplanes utahensis
MQRTALVTGASSGIGLATASALVKRGYRVLGTSRDPATVTQPAAGVEYVALDLTSDASIAALADLLGGVDVLVNNAGESQSGPFEELPMDALRRLFQVNVLGPVRLAQLALPGMRGRGYGRVVMVGSMLASFPLAYRSSYVATKAAVKGFATAARHEYSPFGVWLTTVEPGSINTGISERRTRHVADGSPHRADFDRMLTALDRNEKAGISAETVAATILTAIEAERPRQRYAVGSNAPLVFALRRLVPARLVETITHRRHDLRR

SEQ ID NO: 14602 - protein, 239 aa, Actinoplanes utahensis
MKLIKTTTVAVAAGMLLLGGCGDKKTDAPKADATTTASAATDLTALSADEILTRATKAVHDAKSLHIKGIENGEGGEKIAIDMKQSGKNVLSRLTVNGMNVEFLVVDGVQYVRPDAKMYKTLNLKLPAAVTARLATMWMKPTAGDRVFAPMAEGMTMDNMLKPDGTVTKGETTTVDGKPAIALKSADGDLLVATTGEPLPLKLMGGKDGGAITFSEYGADFPEIKAPAASEVYNLPKTS

SEQ ID NO: 14603 - protein, 599 aa, Actinoplanes utahensis
MSPSPRARRARRLAGAGALAAAVIAGLAVTVATAQAATLFSADFESGSTGGWSKSGGTWSIVTDGSKVLQQSDTTSERAREFGGTGSWTDYAVQARVKATAFGTGAGVVALTARAAGATRMYRLSLTGSNRVQLEAMNGGAVTVLASLAQTISTSTFYTLRLTVSGTTISGTVNGTSVGSVTDPSIAGGRIGLLTEHAAGRFDDIVVDDSGSSTPSSGGPAPSGSSPAPSPGTSTPPVTGALYVAPNGTDGAAGTVSSPTTLTSAIGRIGAGGTIYLRGGTYSYAQTVVIPPGNNGTAAAAKTLSAYPGEVPVLNFSAQTENPANRGLTLNGNYWHLYGIVVERAGDNGVFVGGSNNTIERVVTRFNRDSGLQISRIASDTPAAQWPSNNLVLSSESHDNVDAGGENADGFAAKLTVGTGNVFRYAVSHNNIDDGWDLFTKTATGPIGPVTIENSLSYDNGTLTDGTQAAAGDRNGYKLGGESIAVDHIVRRSIAYHNGKHGFTFNSNPGSLAISNNLSIDNGARNFNFDGGTSVFRNNTSCRFSSGTNDRIIGDSDSSNQFWSGTNGSRCATYSGALAWSFSATGGLLVTIGGRTVTL

SEQ ID NO: 14604 - protein, 286 aa, Actinoplanes utahensis
MSRPVPADLLEITDALLPGAPLDSARLAEHGNMHHVVLLPGIAAVRVSKRAGAAAELPRRVGILHAVAAAGMPFAVPEPMTAVTTFGERAAVAVSWIDGASLPEGTGDPTVFGPLLDALREVRISPELEAALHRPRRRADDGSGWADILNNQVIPRLPARWRDRVRQRSDELLAIEEVPASLVHGDLGGGNVHFGADGTLTGVLDWDMAILSDPAIDAALVATWHGWHMLRAATDEQIYRRAGAWDAAVGAGHLHAILRGRPLSNVDGFVRSVIAWLEDPGRCRDR

SEQ ID NO: 14605 - protein, 1529 aa, Actinoplanes utahensis
MAGGNAVGGQRVQCRVDLRLAVERRRVPRDRRRGRGQQCAVRIAARQIDRGVGGGVPLPRGPRHAQHDGAAATPRLHHPGGRELGIGGRDGVPVDAGAGGQVADGGQRVALAERPGLDQRAHRAGDLRGGVPLDHTAHPTSYVLGQNTGAHCSAPSADHDGMNVGHRARLDDQPTELLARAFDRSPVPKLVLSLTEAEYGQFSAVNDAFCELVGYPREELLGQSCLMLLDQDGLGPVTELFAAMVRGELSVMAMERVLIRRDGSRVWIVSQNVLVHDRDDHPRLVAEIVESSSRPALAGSEARFRTLVDSSPIGMAVLDPDGAWLRVNPAVSAILGYTGAELAGLTLGGLTHPDERADCAAMLRDLARGARPGFEGHFRYVGKDGRVLWCRLTVTPLHAESGAPLELLAQLADVTAERRSQELLVEAEQAAAREAGRLRTTITVQREINAVAENRDALVRLIADRILQVIPAGRSASVHLLEDDSGMLRPVADAGMTLPAVPVTESLAGVALTSGGTVRSDDTAGDPRVNPVIARATGMGSLVIAPLRAPGAGPFGVLMVGSDRPYAFDDGDERQLTLVADSIGSALRHAENTAARAATLAALEREQQRLARSERQFAEVADNSPIARIVLGLRAGRRGRILLTNPAFCLLFGYPDAEALGMHFEVLLGGPDADLERSLDIMAAGDYPRGARELVLHRKDGTPLVVTAHSSVITDENGPATVVIQLLDVTAERAAGRSTEREVRRLRATLAVQRAVTEAATDRAAAVRVVADRAVELFPAADGAAVELIDGDQLAYVATAGTLTPFTGTRIPRSGSLSGIALSTDAPAHCPDTTTDPRVNQAMCAKLGIGSMLIAPLHAEHEVIGVLKVSAAAAHVFDDTDEQQLALLADSLSAALRHADDATRNAEALRRVEISERRFRLIFDNSPLGLTLCSLRTEDFGRYLQANPAMTAITGYTQDELRQMTFAELTHPDDVASTRDYARRFIAGEIESAGMERRYVHRDGHTVWVALRVALIVNDDDHARYVVIQVEDVTAAREVDAQLRRSARLFELIPAAVVVRDPDGTIRWWNDGATRLYGWPLPAAAGKRAHRLLHTTFPYGGSVAEQQEALSRDGYWNGQLDHITADGRTVTVLSRQVLHHLDPDHAQVLEVSSDVTAARAAEQALAESEQRLRAQFANTGVGQIIVALDGALIRANRAYATMLGRTDDELPAQYDELLYPDDLVTHRSLLAGLFAGDSESYTTEARLAHADGHWVPVEATISLVRDPAGHPKLIVGVLADITARRAAEQARDAASAALAERNTELEAANQLKLDIIGMLGHEIGNPLTSIRGNAEILTDDWPALTDDRRGRAIEAIARQAGALDEIVQEVLAMVTIESGKIRADRRALRAREEIDRAQWAAQGSEPVPVSGPDAVVLCHPGHLQQILVNLLSNARKYGGGATAVRVAETGGQVEITVEDDGPGVPGEFRSRLFERLARADRDATTVKGTGLGLYIVRGLAQANHGDIRHEPNPSGGSRFILSLESATAA

SEQ ID NO: 14606 - protein, 281 aa, Actinoplanes utahensis
MFHGLSAFPLTPIADDRVDADAYTGLVARLAAARVDSITALGSTGSYPYLTRAERAATVRLAVAAAADIPVFAGIGALRTSQVLAAAADAQQAGAAAVLLAPMSYQPLTPDDVYGLFEAVVAELSVPLIVYDNPGTTHFTFTDQLYADIAALPRVASIKIPGPASAARVATLRGLLPPHVAIGISGDAHAAAGIGNGCDVWYSVLGGTLPRAAQSVLAGGSDRLAPLWDLFAAHGSLRVMAAIAEQLGLARRSCLPHPLRGLDDAARTRVAAVVDALDLAG

SEQ ID NO: 14607 - protein, 142 aa, Actinoplanes utahensis
MGPTVVAAVSAWSGPAAAALLLAGATALAAVLVRMLLYAPPAGTPSEVPRPGRTLTLMVRSGTLRRTLYLTVTVAFALAALPVTAVAAAPMYRVAAAAAGVLTAAYGLGNLAGSAAGVLTAAYGLGNLAGSAADRRLARRVT

SEQ ID NO: 14608 - protein, 119 aa, Actinoplanes utahensis
MDEVAGAIADPVRREILLMLRATPLTAGQVADRFAISRPAVSRHLRVLREAGLVRDTVEGRRRVYTLVTEPLDELAGWLARLTRPSGWQHRLDALETEVHRTRRERRAATPDRSAKESA

SEQ ID NO: 14609 - protein, 159 aa, Actinoplanes utahensis
MSPTPTGRLLGDDLVLTRTFRAPIDDVWASMTESDRTARWFGPWRGEPGPGRVIKVQMAHEEGRPWMDMTIDACEPPRRLAVCAGEETDRWRLEMTLAEAAGVTTLTFTQHLTTLDGVGEVGPGWEYYLDALVAARADAPMPSFDDYYPSLKEHYESQR

SEQ ID NO: 14610 - protein, 178 aa, Actinoplanes utahensis
MLRPETDRNGCQAGGMDSEILAAAPGGGAALNPFVIVDDAAGFVAFVVATFGVRETVAARTGMPDGRLIHAEVRLGVVDLMVADRLDGWPARPGLFQLWVRDAAAVLRRGAARGAEAVTPPTPFYGERTLARMLDPWQNLWWLYEPAPGQPDPTPAWAGGPGTVFRTLDRALKGLGQR

SEQ ID NO: 14611 - protein, 269 aa, Actinoplanes utahensis
MSQDIARELGVTPTFDATAEITRRVSFLAGALAASGTRALVLGISGGVDSSTAGRLCQLAVEQSRAAGHDAEFIAMRLPYGVQFDEADAQTALAFIRPDRVLTVDVRPAADAALQALLAGGMTTRDHAQQDFVHGNIKARERMIAQYAVASAVGGLVVGTDHAAEAVTGFFTKHGDGAADLVPLTGLTKRRVRALAAALGAPDTLVRKVPTADLETLRPGLADEDALGFTYDDIDDFLEGAEVKPEIADAITTRFHLTAHKRRLPAAPA

SEQ ID NO: 14612 - protein, 187 aa, Actinoplanes utahensis
MIDTAPGADLHPGLDLANSRLVAPGGVVTDLLATPAEAGDWLIARGLAPAGARLQEVCAGRLRALRGAVRELLDASVRGGEPPRAALDAINAAITRVPTAEELRWSSARGLHRSAPHPTDQVVDHALGILAADAADLLTGPDADRLTACDSSPCQRYLLRSGRRQWCSVRCGDRARAARAYARRAGR

SEQ ID NO: 14613 - protein, 242 aa, Actinoplanes utahensis
MINVQTAGGPTALFEYAGLRLLTDPTFDEPKSYLSPSGTRLTKLAPARIRPAALGRIDAVLLSHDQHADNLDDSGRALLADVPVTLTTTDGARRLGGTARGLTPWESVTIGDVTITAVPARHGPEGCEPVTGPVIGFVLTAEDQPSVYVSGDNAALEIVEQVADRLGPIDAAILFAGAVRTDLFGGALLTLDSEQAAEAARILDARQVVLVHHDSWAHFTEGRDALEKAFTAAGLRDRVQFG

SEQ ID NO: 14614 - protein, 155 aa, Actinoplanes utahensis
MDTASSWTARHRTRTADTRAGTGRLSAPAGLRPGYGRRAAAARRGGRDDPGGGGRVRAAGCDVRAGSRLPYLMAKAGIGAPDGTDVAGRRLPVGQDTPILESVYRSLLPVACAHGITTPEESARSIAELHRATAAAPDRHVLLPLLNGAWRVKGV

SEQ ID NO: 14615 - protein, 355 aa, Actinoplanes utahensis
MELLTIGAFARAARLTPKALRLYDEVGLLPPRAVDPESGYRFYHPDQLDRARLIARLRRIGMPLAGIRTVSDLEPGAAADAVTAYWRQVTADTAARAHHVARLVQHLSQEGVTMPNTHSTPAIRYAVRCDQGHVRDTNEDVAHADDRLLAVADGTRGSGAAASAAAVDALKSLDPAGRPAAELLALLAATVDGVDRAIRATGTADDRPATTLTALLFAGPRLALVHIGDTRAYLLRGGELTQLTQDHTWVQSQVAAGRLSPAQAATHPQRALLTRALGGGPQPVEADLALRTVQAGDRYLLCSDGLSAVIGHDDLHTTLTETATPEPAVDRLIDLAHAAGAPDNIACLIADVITT

SEQ ID NO: 14616 - protein, 268 aa, Actinoplanes utahensis
MPNPTRLRRLRHNPAMRERSKWIVVGAVLVVLGGAAAGTWRYRQHVQRQPDWQIHHTAVPDAAKKVDDVLAGFDRDHLYQAADYLHSAGRHPGVQVLSVTGQTHWQTGVTLTLRVTGHGVARGFDQVILQQRDVPICFRLTMGPKDDSRDDDIDCPTGPPLAVPRDPTLDGVDPRLQAALNPVGPDEPAVRAAVAGLKLDPGIRQDFAAHDGVVGVALRAGRYDCVVARVVARGDVTLWRPSPTQLAPGELDCSAGLAMTSGFNTSPH

SEQ ID NO: 14617 - protein, 107 aa, Actinoplanes utahensis
MRGFALLLALAVAVLVAGLTFALVAAIGRAARRRAVRAARWRPRHFGRDGTTVVTVSLVALDGRILDEYVVERIAAAEPDWTDRFLRAHQVAEERAFHLNSADTGRR

SEQ ID NO: 14618 - protein, 335 aa, Actinoplanes utahensis
MATQRGHGQPARRIAPLVSAGVVGMVVLVVALTAAFGGFDKTTGGEVGVVRNGGWFDNNRVRQVIQPASGLTWTGLYSTTHKYPAQQRFYTITSDARRGDRTGVDVVNTPSGDGVDMGIEGTVYFTLNLDPTTMTTFDNKFGTRQFRGTDGTLRYAYDGDEGWSSFLDAIVRPVIDNDLRIQISGFRCAELVSSCALVQNGAQGTANVGTPPAAATGQNNNSNIAKVQDAVNSSLAKDLADMLGGAFFEDIKFNLARVTLPAAVQDAVNKAQAAYAAVSEAQARVAQAKADADANKTRQLGYNACSACAQIDIIKALPPGVTTYAPGAGAAVPLK

SEQ ID NO: 14619 - protein, 211 aa, Actinoplanes utahensis
MPNPGTVDTRLAAASLPPPAPEIVIGMIRHIAAAACTIAVATGAYGYHQVRDAVPHRAGHFPVASPDVHGSFPPAYLADAFGCAGDNVQPRLTWSAAPAATRSFAVTMYDPDAPTGSGFWHWLAWDLPATTDTAGSTLPSAAVTGTNDAGRTGYLGPCPPTGDIPHHYRLTVYALDVPTLSLPATTPPAVAMFTMSSHILASGAITVTARR

SEQ ID NO: 14620 - protein, 325 aa, Actinoplanes utahensis
MVQAAAAMCRIMPMTISGAGGGREAAASLVSTVPGFGIDTRRAARHDGAVTGERRVELAGFLRARRGGLTPADVGLPAGPRRRTPGLRRQEVAQLAAVSVEWYTRLEQGRVGMPGAAVLDALAGALRLGEAQRRHLHLIARGEAPVQRHEAAPVSRSLRVVLDGMPLLPAYIIDFRFDVLACNAAARALFGDRFGAENVARQVFLDAGLRTSQLDWAQIAREMVGNLRANQARHPRDARLREVIDGLRRESAEFAGWWGDQTVVERSHGRKRIRHPVAGVITVDYDALATRDGSGHSLFTVTPAGPADERALRLVIGQHSRALLA

SEQ ID NO: 14621 - protein, 129 aa, Actinoplanes utahensis
MCFALISASVPAARMTARLGVEPDEVRVRGSEQTAPMVVPVAHSWEVHCRKPDLTVDEQIGLIVDRLSDHAARIGDLAAELAERDGDEGGSLLQVVRCVTGGDPLGWHLDARLLEFLRLTRAELDVDES

SEQ ID NO: 14622 - protein, 199 aa, Actinoplanes utahensis
MNGLSLCSGLVYEDRSDVRYVTVRYPGQRDGYSRPVASRTMRGSTIAAVATFTLLAITGCANSDNTPTTATAAGAANTAGLDKGSAGACTVADQATRGENGRDLDLATAKDIVAFGRTSRSTIVTAATDVLSAALDKAQAAAGEPDELVLKAEVGNAILKVQTVCKDPDAVKASITTPSTGGAGGSNEPTRSVKDGQIK

SEQ ID NO: 14623 - protein, 97 aa, Actinoplanes utahensis
MVPVETEVTPVVLDGGDRRCVLLLIELRRLIATLPAGAVVHLIATDPAAPLDLPAWCHLTGHPYLGPVPGDRPTYAVEVAAHATSTDATRPWHPEAG

SEQ ID NO: 14624 - protein, 238 aa, Actinoplanes utahensis
MPPLLPIGFTDRVDNQQSGTRITSMDSEVGRSGRVRVAVLAGAAILALAGALYVLRRPLMMVVPACTGGQWTICLTTVNGDLLLTVAALPVALLLVAALAHRRRLAGTPAAWRLSLAEVGLVYWTVPWVWLTLQPGPGAGVVPGRVSLVPLRDLLTMDTGQIVGNLLILAGLGFFAPIRFRALASAPRMLALGAACSALIETAQYAFQLDRVSSIDDVLLNATGAALAALASRRWWRA

SEQ ID NO: 14625 - protein, 110 aa, Actinoplanes utahensis
MTLCPIPLPGQPADTPESTEPPWRPTCQLPLRCGPRTGEQPGRVRIEAAVGGQGDGEPLCRQQLGERFMAVAVVGVDGISARGGLTTHDEIEANTNATMIRRAGTEVVVV

SEQ ID NO: 14626 - protein, 126 aa, Actinoplanes utahensis
MTSRIGDIIVDCRDPELLAGFWCGVLGYRIFARDATGVAIRGATSSPDILFLHVGDRKATKNRLHFDVCPTDRGQDEELTRLLALGARRSSIIGSGSWVVLEDPEGNEFCLMAKRIAAEPAPFHDA

SEQ ID NO: 14627 - protein, 194 aa, Actinoplanes utahensis
MDENLGLRERKKMATRMALHEAAVRLAAERGADNVTIDAIAESAGVSRRTFTNYFANKEEVFYYREAHRMRRLCASISAQPTGDPWTVLTGAALELMTEAATDPSDLWLKQRRELHRDPHHLAHQIAAYTAIEKELAALIADRVTGPDADLRARVLVAQFMTAFRSSVQYWMEHPETSLPETFRKVTAMVATVA

SEQ ID NO: 14628 - protein, 496 aa, Actinoplanes utahensis
MSAAEPGELLDRGRGHRGEQVDQAAARVAQQGGPVAPRHGGRRQQHLAGGGDGVDVVDQEFGDPLPRPDGRWHGRGAGDREGAAAGDDLGEVRGDPVRGQAGDLLVEVDEPGDVGGDHALRNEVHAEQARADTGQLPPTIVKGVTRPTARVLTLLELLQSGGLRTLADLSERLGVDARTVRRYVQHLVDLDIPVESVRGRHGGYRLARGHRLPPLMFTEEEALAVLLGLSGDSTSSATAAAKLRRVLPAPLQRKLDAVRESLTVTTPAAAAPDGTILLTVSAALRDHQPIRITYGGRERTLHPYGLVRHHDRWYVSGLDPEIGAERTFRLDRVEAARPLPGTFPPPSDFDPAARLLAGFATAAYRHAVRVRVQATADHLRSRLPAGLAVIHDDGADWVRVDLHAERLDWVPALLAAVDRPFIIEQPPELRILVAELADRLAAASRRPEHPRPVTPARRRPRSDAADQTGSGVSSPLPGWAAGSTSPASRPRPAGPD

SEQ ID NO: 14629 - protein, 254 aa, Actinoplanes utahensis
MLGFRRLRGSPVPKLNQIIAVEKGVKSKAFADLSDAHHAVQKTGPLAGISRTYQPKDEEGEQLPAESTRVQIKAEEILRDVGATLTRLFDVTATKDWTNGVARADVVVDGRTIAAQVPVTYLLFLEKQLVDLHTFVKKLPVLDAAESWLRDDSTDSWRTEPVRTNRTKKVPRNHVKAEATDKHPAQVEVYYEDVTVGYWTTVKFSGALPAKRVNEILDRVLALQTAVKFAREEANNTEAVDQRVGAAVFGYLFG

SEQ ID NO: 14630 - protein, 201 aa, Actinoplanes utahensis
MRRGRLLTWIGPAVVIVIVAVYAGGMLLGRWRSPADAHAAGSRQACPESTDPGHRKAETELCPLINRPEILTLVDASGTVKGISTSYDPHGEWYECTVTLPSGSLRLNVWKGRTRLADYRKLIPEAQPRTVLGRPAAWWPDSAAIQAIPVKESSVLVAWDRADTGGMVEISTIRTELDPADQAPLTRIAERQLPGLPGWPA

SEQ ID NO: 14631 - protein, 316 aa, Actinoplanes utahensis
METRRDVIVRAATLADELGFELFSVAEGWGLDAVAVLAELATVTRRITLVAGVLSVWNRTPATLAMAAATLHQLSGGRFVLGLGASSPQLVEGWHDLPYTHPAARLREVTTRVRDLLRGERAVTCGARPLRLGQPPVPDLPIWLAATGERTLRATAELADGWFPLYLRRDRIRELRPAITASRPVTVTAGPFAVVDPDVDAARAAAAACTALYLGAMGDIYPRLVAGQGLAAEVAAVRATRVVPAQAQPLLDEFTSYGTAETVAADLARWDEISDVTVVVLPPGLPWPRMEATIRAAMPVRPASPAGRGVDARRSG

SEQ ID NO: 14632 - protein, 37 aa, Actinoplanes utahensis
MRGRLGEAVFLPKPGSRAAVPNGAGGGQAVRSAGISE

SEQ ID NO: 14633 - protein, 184 aa, Actinoplanes utahensis
MSGNVFPDAILQTARLTLRPPHEGDVDAIAAAASDQETQRWLPLPFPYERGHAVTFVAETVPAARASGAGLVRAVECDGVLAGVIDLKKTDWRHRATEIGYWATPAARGQGVITEATAALSRWVLTGAAFERVVLRIAPANAASVRVAEKAGFTFEGVARNAGMVHGARVDLAIYSLIPADLTA

SEQ ID NO: 14634 - protein, 90 aa, Actinoplanes utahensis
MAVDHHEAIHEIRRLLTDAFGSGDTVGCHDHLIGPVLVTLAGAGAADDARLWLDAEIRRHLGETAGRLDTADVAGRLVTWWADRESRRWG

SEQ ID NO: 14635 - protein, 71 aa, Actinoplanes utahensis
MRVTYDSEANAAYLEVDEIADGAAVENVVVERPGRGDIVLDFDADGRVLGLEVIGATELLRAPVLDAADRL

SEQ ID NO: 14636 - protein, 148 aa, Actinoplanes utahensis
MIRPITDRPRQGDTSGMPEARVTLPTMDSGISDDGTVITFRTVGTGPGLVVPGSNRRAHHYDRLAALPAGSRTPPYLRDILPPLARLIPGAGYEILPGLDHNAPDRNAPETIPARLTAFLHPMIAAYAPPPPAAEPLDPATVHPPRDR

SEQ ID NO: 14637 - protein, 334 aa, Actinoplanes utahensis
MLAGRLNVSTGTFAVEEVDEPHAGPGQVRIAVRAAGVCLSDVHLIQGMLKPLHLRGDSVTLGHETAGVIDEVGAGVTGLTVGERVLLQAGEYAPDGSVLTRGVDYDGGWAQYAVATAGTVVPIPDTLSYEQACFIPDAVSTPWAAITATAAVQPARSVGVWGVGGLGAHAVQLLRAIGAAPIVAVDPLEAARERAVQFGADLALDPNDPAFAAAMGTATGGAGLAYAFDFAGVAPVRVQAARSLTKGGKLTLVGLTDQPLTIPDGTRFSYLSQEIRGHYGSGPEHVLELLSLVALGRLEFSRSVSGTVPLADAAEAVRRLDQKEDNPIRLILVP

SEQ ID NO: 14638 - protein, 478 aa, Actinoplanes utahensis
MPSPSCSPSCSATSRGSRPTTVRRGGIPASRSCARRPCSVTCSSTWPWASNPGSARSWPSCSRTARTGWPSASPAPRARSTTGTWCSAATTPTTWGRSPSSDARSASCCAGRCRRRRPAPSGCTGRRAGGPRSARADHRDPGAVHGGTLDLVEHGDGEIGVRQSAFADRLTAQPVTAQAGQFRRQQRRRGQHDPAAVRLAQPPQAGGVRVGERPELLGQRIGTVQVADQSDRDDPGDAGIEERAGGRGEEVRIQVECRQLLRAGRGAHRVHRGVVPTDDRGDARGVRDVTGHGGKVGMAGGVTDDGGHGHPAAPGLGGDGAAGAATRSEDYDAGHVGHGRRRTPGYRNETGGTLGVMTASLSPDMFDPACPTTAMPLQIGDKWTAMVVLCLEHGPRRFTELRVPLRRVTPKVLAETLRAMERDGLLNRTAYDENPPRVEYALTPLGRSLLTLVDAARAWCTDHFDDLLAARTASAAGA

SEQ ID NO: 14639 - protein, 158 aa, Actinoplanes utahensis
MGVVALRPLADADLDALFTMMRDPEAVRMAAFTAKDPDDRAAFDAHMARIRTAPGVTLRAVTLDGRLVGSISSFPMEGDTEITYWIDRAVWGQGVAGRALAQLLDLVPTRPLHASVAGDNAASLRVLQRAGFHIVGSARGYANARGAEIEETLLRLDR

SEQ ID NO: 14640 - protein, 335 aa, Actinoplanes utahensis
MRPRRRRAAGRRGAARFPGLRRAPAGSGRGARPGRPVPHPAPILTGVDPSSPARLAVVSGGGTGIGRAVARRLAAQGDRVVIIGRRAEVLHRTAAAINAEVRRPAATEDSGTLRLPAAAENGGAVRRPAAAGDSGAVLPISADLTDPDQVERVAGEIGRLGPVDVLVNNAGAIITPPAGDGLGALAAAWRHDLDVNLITAVLLTSALLERLARPGGRLIMISSAAAQRGGSGPHSAGSYAAAKAALHGWALGLARQLGPDGITVNVLAPGYIEDTGIFHGRDTPDFVTAKIADTLVGRPGTPADVAAAIGYLASAEAGYLTGQIIGLNGGAVLGR

SEQ ID NO: 14641 - protein, 154 aa, Actinoplanes utahensis
MRHPGDRRRAADGVSLGQFELLRYLREHPRSRVADLAGWFAIGVGATSKGVDRLEARGWIRRLPNPADRRSSLPELTEAGAGALTAAERTFEAEAAQLLGLVLTRRLWPRRPLPSAYSARLLGSEIWVPRWADRELALVADLRRQAGALSNPRL

SEQ ID NO: 14642 - protein, 214 aa, Actinoplanes utahensis
MSDPIKLLVVDDHPVVRDGLTAMFDRDPEFAVVGEAADGAEAVRIAEAVGPDVILMDLRMAGMDGVTAITELSRRGVPARVLVLTTYDTDAHVLPAIEAGATGYLLKDAPREELLRAVRAAARGEVALSASVAARLMSRVRTPAPTTGPLSPRELEVLRLIADGNTNREAAARLFITEATVKTHLLNIYAKLNVKDRAAAVAAGYNRGLLSAPA

SEQ ID NO: 14643 - protein, 287 aa, Actinoplanes utahensis
MAGAATVAGTAQATGVEYGTVTGWLTWLAVVAANIVPMILVSWIGEISAQHHRAREAAVAEIAALQDRLVEQARAAGVLDERARMAREIHDTLAQGLTGIITQLQAAEHAAQDPAAWRRHHAAATALARESLAEARRSVHELRPEPLETGRLVDAVTEVAARWSARQGIPARVTVTGQAMVLRPEAEVALLRTAQEALANVARHAGGATRVGLTLSYMDREVALDVRDDGPGFDRDQAPDHRGGGFGLVAMRQRIEALSGTLQIESAPGAGVGIAACLPLTTAEVHP

SEQ ID NO: 14644 - protein, 134 aa, Actinoplanes utahensis
MREPGTRGGLRDCVECRPWGVSVEPQDSPPWERRFEPLVTVVPYGLLAVLAAMTVALGRDVRVDLLLGAGAAVWTLVLFTLRPGWRRRPVIMGVFLAGLILFGLVMVARYPWWGFYTPALYFYAFRIIGWPQEL

SEQ ID NO: 14645 - protein, 212 aa, Actinoplanes utahensis
MPTDWYRTTEWHESAQAEFERRLARARPSSRGQYLRIKAVSLAEAGIVDGARDLYRRVVKVDPDGSSAASATELLGDLERAQGNAAVAEQHYRTLLDRWPTLNGTSRLAELSLAELLTEHGDAHHLAEADRLLIACADRGLAFDDAIFRWNVARARLADRLGDDQSRAAAATTALALVGKGPQLPRHPDVGLVRTDEATLRWLKRLTNRPGG

SEQ ID NO: 14646 - protein, 168 aa, Actinoplanes utahensis
MPALSRLTGMASPVGACWSSPRRSIADASSCVWLSLHLLLYFMLDVATLTALSAPEVGGGLHFASKALYLFGLVLTSVLWPLPLQSAALLLAVGALAILRSGAGLPRPWFRIAAVSVFLILPLLLALLLSPGDSAPFLQVLPMHILMGLLVVQPRWPNMVPSRDRHRW

SEQ ID NO: 14647 - protein, 152 aa, Actinoplanes utahensis
MTTQDAVAPVYSFSPRFHEIDGQGVMFNMWYLSHVDEAVDVFFEGRGLPYQQWHGLGFDVHVVHVDMDFAAGVRRHERTEVLISTSRIGSTSFTLDFAFRREGRTVCSGGIVYATVSTQGHGTVKLPDPLVKALGAESPLRAARRHAGTPAS

SEQ ID NO: 14648 - protein, 55 aa, Actinoplanes utahensis
MPPLACDRRRLTTVTVQGRIHRLPNGARLVVLLDEPATVDGRICAGVHARWLRAT

SEQ ID NO: 14649 - protein, 421 aa, Actinoplanes utahensis
MPILGCTKHSPERLRPVSAPTYAAPAPSPASPRRVPVRAVHATPPRVAGQRRHRLRIAAVLALVALFGTELLLGWSSLAGALHHLRRPHPGWLTLAVLAEVVSMNAYARMQRHLLRSAGVRARIVDTVRLAFAAHSLNETLPGGAAFSTRLNYQQMRRFGASPAVASWVIALSGILSSCALAAITAGSALAAGGDADWRHLLGLLMATVLLILGARRLAHKPDIVRTPLAAFNRLRRRPTTDGHDRVSAFLGQLRTAQLRPSMGFAASLLAVLNWLLDALGLWLCFRAIGEPPPSITATLLAFCAAMAAGGVTIVPGGFGIIDSALILGLITGGVATPAAVAAVVLYRIVSFGFIIGLGWLSWLRLRRLATPTAADRAHPDRTAADRTHPERCVPPRRRRPSRWTGNHPRRPSTPRPSGTP

SEQ ID NO: 14650 - protein, 261 aa, Actinoplanes utahensis
MTTLATTFADSATMFRRQLLHLRRYPSLTIMLIGLPVIFLLLFVYVFGGTLGAGLGGGRAEYVDYLTPGILLFTVAGAVAGTAISVAMDMSEGIVDRFRSMAIARASVLTGHVLGSLVQIFIALVAVLGVALLIGFRPTATPVEWLAVLGVLLATAFALIWLAVALGMAADSVETASNTPMFLSLLPFLGSGFVPTATMPPGLRAFAEYQPFTPVIETLRGLLLGSGIGNSALIALGWCAVISALSYVWAKRKYNQRAAGK

SEQ ID NO: 14651 - protein, 315 aa, Actinoplanes utahensis
MTATVTTRPAVSVAGLRKSFGGRLVLDDIDLTVPEGTVFALLGPNGAGKTTMVRILATLLAADAGSVRVAGHDLVREPDGVRAAIGLTGQFAAVDRLLTVRENLKLMADLHRLGRSAGGRRVAGLIERFDLGESAGKPVQLLSGGQQRRLDLAMTLVGSPRLIFLDEPTTGLDPRSRHAMWQIVRELVGEGVTVLLTTQYLDEADQLADRIAVLDHGRIVVEGTPAELKRQIPGGHLLLRFADPAGLAAAASVLATVHRDDDALTLQVPSDGGVGSLRTVLARLDAAGAEPESLTIHTPDLDDVFFAVTGHQESR

SEQ ID NO: 14652 - protein, 281 aa, Actinoplanes utahensis
MPLFDTPGPIAVSADLVAADLHVIASDRADTVVTVTPGSAGEDRDVRAAEQTRVEFASGTLIVRGPRQAGFGIFGRVGTVDVVIEVPTGSDLEVKLGVGGARCIGAFGACRLRSGAGDLRVEQAESLSMTTGMGLATAESVTGDAHLTTGSGKLRVDSVTGPAVLKNGNGDTWVGHAGGELRVNAANGDIGADHATGPVTANTANGNIQVRELVRGVATLRSSAGRIEVGVRTGTAARLDVHTSYGKIRNELTAADGPAETDERAEIRARTSFGDILIHRA

SEQ ID NO: 14653 - protein, 98 aa, Actinoplanes utahensis
MELRPYIDALRHELAVAAAAGGEEARELAERLTAPLESATRLALLDALSEAAAEITRDLAPGSVDLRLRHREPTFVVTAPAADPWSEPPVPEPPAAPG

SEQ ID NO: 14654 - protein, 83 aa, Actinoplanes utahensis
MKRVSIVVVVLVPRLTAVGGAGQVRAQHRKTAAEPATTRRLAALEASKTPLQRAARGIDLARRLGRVTNFAVVPSVMPPGITG

SEQ ID NO: 14655 - protein, 484 aa, Actinoplanes utahensis
MRLLALGAAAVLSAWYLAAPGPLTAQVITCWVAVGSYASMMSYFAFRAGALMDRADPRRRFWRSLGLAAATWAAGEWAQIATAVADPDSVAALTGTGMVRTIALSVGCLGLTGVVLTYPVGHRSARARLCYLYDLATVVTTAGAYGLCWAASAGGGSGFAYDMFTVGAAPVVAMLTAFAIGRLYLSGAAPFRWPLGVLGPFAAGVEGLARGLGPELVRSGHPGVIFALTVTAHALLMMAAWAQYRTVHVLPDRVRDRPYSLLPYVALAAGFALLVGTLAFDGLDRRAWIAVAGVVIGTGIVVARQLTAFVANAELLAERDALAGRLHTMAFTDSLTGLSNRALFLDRLGAASRAGVLLIDLDDFKPVNDVYGHAAGDAVLVEVAARLRAATGPDQVAARFGGDEFAVLATDATAGDLAALAERIVQAVGEPCRLPDGRHVRVHASIGVATGDGRDATALLHAADQAMYAAKCGGKGSYRLAPTG

SEQ ID NO: 14656 - protein, 186 aa, Actinoplanes utahensis
MWWPDLAASPPRRLAASPPRRLAASPPRRLAGLLRSPIRPAGAEGPASAGWCRGISAPAGRCRGTSVGRVVPRDQRAGRPVSRDRPAGSVGRDYSVRSAVAVRVRAAQPAGSRAVTVGGRTPQAWCRAGAGRRCRSWPGRPGYRPFVLLAPLVAARILGKVSLRDRVEAVVTAYETGPVSPGPPTE

SEQ ID NO: 14657 - protein, 263 aa, Actinoplanes utahensis
MEKRNEQPRSVRRAAAGLRAAAPAPARLRPAARLPAARLRPAAAASAARLRAAAGLRSAAAAPPGYGQQPPPPPPGYGQQPGYGQQPGYGQPGYQQPEYGKAPYGAPGTGVGQPGNLIDRFVARLIDGVIVAIVVSVISVILGILSNSWFLSTFLSAVVDAVLFLGYFAYMESSQGQTIGKQVMKLRVYGPDRASNPTLEQAIRRNIYAGLAILNIVPILGPVISVLAAIAAAVLTAVGINSDPQRQHWFDKFAGGTQVIKVG

SEQ ID NO: 14658 - protein, 555 aa, Actinoplanes utahensis
MWLGPPSGEALVVQQQLSISTGPAEPPLLDRTIGADLVATTARYAEREALVDVVSGRRWTYAELTATVDAVALGLRALGVGTGDRVGIWAPNCPEWVFLQYATARLGAILVTVNPAYRTHELSYVLRQSGVRTLIAAPSFKTSDYAAMIDEVRDECPDLIDVVLIGQEQWTALTGTAPEPGVLDAIGGTLHPDDPINIQYTSGTTGFPKGATLSHRNILNNGFLVGELIDYTAADRICIPVPFYHCFGMVMGNLAATSHGAAMVIPAPGFDPALTLRAVAEEKCTSLYGVPTMFIAMLHHPDFAGYDLSSLRTGIMAGSPCPVETMKQVIDRMGMTEVSICYGMTETSPVSCQTRPDDSLTRRVSTVGRVGPHLQVKVVDPAGATVPIGESGELCTRGYSVMLGYWGQPEKTAEAVDADGWMHTGDLAEMDADGYLRITGRIKDMVIRGGENVYPREVEEFLLTHPDVVDVQVIGVPDEKFGEEVMAWIRMRPGATPLDAANVRAFCAGRLAHFKIPRYVRLVDEFPTTVTGKVRKVEMRDISTRELALTSKSDV

SEQ ID NO: 14659 - protein, 521 aa, Actinoplanes utahensis
MRPDSSEDDDDERPAAGLDLWQLAGLPGGLLQASYLTSRFAAQYRLIVDVLLAEQEHTLTGVAATELPDLLRRRLRHLGVDTALLDDPGFRLKERMARLERWGVVYTFQDKAVRDAEFVLDRDRYQLTETVAQLHRAITSLGDDSAAEAAATLAPGILTANLNLLYEYARTDPAAAAAAWSVIATTHQSMVKAAAGWQARLAGALAGAPTPEKITTVQETLRRYVDMWGAGIDTHSDTITTRAGKLALLPAGVWRRIAVHTLGTNADNPAIDALVDTHQHTLQTLRRWFDGPDCQARKLRRQMRDTIGPLLRGQRTLAAVGGHVSRRAELLALAARLESAADDHAAWRLWCAATGLFSARHLPGETNPPAGSAGAVSFWEADPVPIEARLRKQGPKAVTGTAARIADRTGAKRAARERAARMAAHAALTEAAILARSGQRLSQWRNVSADELQMLLVLLATIAAARPDPTGIRSATTGDARWLLHADPPPDGAPAAIVHTPDGRLVHPDIALHITPAGSRP

SEQ ID NO: 14660 - protein, 387 aa, Actinoplanes utahensis
MNTATSAVEKQAQQAFLGLLAQPLITPATNRILHRHVLRHQRQITDHARRAGYRIQRVGRAVRLIRVPIGGQVTAPPRPAGAPGRRLLALACCLAACCEEVSTTVTLQQLSDMVRDLTGAAGSTVTGYDPELKPQRRLLRDAATLLADWGVLRRRTSDEMLLDWTEDGAGPGAGYDVDRDALLLMTSPDVLAAALHTAAADAEQLAATRTVRQLRELLETPAVVYADLDEHDADALRKARGLRTADLAQMTGGTVEARAEGLLLVLPDDPDRQPSVVDWPRARAADWVALLMADLAGRHGARTSTGTVRLTGTQVDEVVDDLVAWRGDYMSKDQKTVPGSVRADAETILTELGLLQVGADGSWTLSPVAGRYRDPDITLIDTTEPTR

SEQ ID NO: 14661 - protein, 1045 aa, Actinoplanes utahensis
MTMIDLPAPGPAATDEQLAAWRDAVTTAGLPAPSRSRWQVLRAGVIGLWEFDVAEYWFADGRAQFVGQNQSGKSTMMALTTLLMLAGSLDRKYVDTFGESEKEYRYYVEPVTDDRDRRDASTSTNRGWAWVEYGRVGPLGAPEFFTTMLYTQTKRGVKQMTRAWVVCRGTARVRDGLDLAVGQAVTEPRELEGVDGLTVYPKGADYTERLATDLFGFDDTERYATVIEMLKVLRTPHLGQKLDPAWFTSQIRSALPPVAKSEVTELANGWQELEQLAHDRDHADEARKAITVYLNRAWRPWADAVLRLHADTLIAADAAFIKAGDDATAAERKLEQARARLNEETQNTIDLEKALGRTRADLMQLLRSSAYTTAVDRADDAKRLRADANAAAERARKATAQLATTRVDLQKATGRRDTTRAELGVARDEVEIAGGHAVEAATAAGLGEHAPAWAAAGDVDRFDAAIANRRGQVAALRKLIRAASTAAATWNTLDDLAQKAQTELHNRTAAATATENALQQAVQTLSDDLERWASALDEWAPPTEIRTQWITAVTDQTRVERPRELLTALLTHQWLEPVTVPLITRAADLRAAAKTATHQAAAADAEADRLAAAGDPIPSPPARWTRRERPAFPTAAGAPLWRLLDPVDDLDPAVLDHVEAALAAAGLLDTWVTPDGTFNPEHGADVVITTGTLPAATTSLAAVLQPAEDAATLTEAVTKVLHGIGYTPDGPLTTTVCLAADGRWQTTAAAGRAAPAEHGAALIGTAARAATRRRNIAELRARATAFRDEAQRLAGEADTVSTRVTSLRAIAGQAPTDADVVAAAAAHTAATAEAEKAGTAHRDARSREAHARTLSQEKSAEVTRYGTDNRLPTGEEHLDALAAALDTTATAAGTLRLALRGLTAATAAATDAADRFITEEDRVSAATTLAEDEAAAAELADTNATLAEQFVDADAQQLFAQAEELERRVEEYGPSISASRREGLARSKEAGEAENAWKSACKDHTAAGEHRDVAATAWWTPVDAGLTTARNLPTPDSRDLPAAPS

SEQ ID NO: 14662 - protein, 383 aa, Actinoplanes utahensis
MLGSALIDLRTVLEAHGGRSVITTEADEQHPLPSVTLIVDASGTPLDPAEAILHLQKLVDDLSRTHDEKLHQMYTELLSSTFIDHLADRMRKVITLLKIVNDVLEKHPTGANKTTLRLRRVPAEGQTPGFKILKALLDGTIESDAAQQQIQLFLGARLREAQEAGLVGTEDWTDRLAELLDYRAWFDVVAQYKVGDSDEDENRWKDLTRKVHGVDSGGGKVVTLLQPLLATLVALYSESPNAPRPLWLDEAFEGVDPANRATMMRMLTDFDLDFLLAGPAPLVAVAQVPAAAVWIITRAPAPIPGVDLSLMLWAGHTLEQIPVGDYATRLLTPRRSAENLGPDLFAAMLTDPAPAEPSHTNGADHTDTEQTSDAAGIGESEPA

SEQ ID NO: 14663 - protein, 403 aa, Actinoplanes utahensis
MSAATDRWAAQPGPRKVLTAVRELLQERRTGNGVIVRVELTATQRAQVARYLGVAWDTSGQPVTLGRLRAALLRAGDDLLDLLTRTGGAIEDVRGRRDEAAARAAARIDAAYTGLTTAGLPDHAVRLARKRRWLGTDPETATRRSDDLQHLWQALPGTGRPLAEIANSLYGDPHRLDRDHDLGRAAARLLAAAAAAADDDAAFAADTALTADRWRQVWSQYGIGCDEVSATVLVLNLPLIGKAPAARIAGAAAVHGEPVWLTSRSLRGDWTPGPDLTVVRVCENPAVAEAAADRLGSACLPLVCIYGRPSSAAWTLLRGLAADGVRLRVTADRDAAGRGFLTEMLALPGATEWLPDADGLYEEARLEALVADLDPITRAAGDRDDHGEGLLPGPDPKPTMGFD

SEQ ID NO: 14664 - protein, 219 aa, Actinoplanes utahensis
MSHFGVYVCLAPGAEADWQAAVAAVMAPFRIDDETGLGEWDHWHPSGQFLVRPEYADSPLILPSTRWPADPLRCDGGPKRMLDLEGMRTAARDRAGQLWAAWREAVSRHPPARSLETCASREAYEAQPLIAEIRARSDDEGDVFGLLWTDGRDEVTYLGDDEQRFLDTAVESALMTYALVTLDGRWLDMEQTPAFASLVWPCLEGLPEDAFVIELDCHC

SEQ ID NO: 14665 - protein, 137 aa, Actinoplanes utahensis
MSPDSPASTSPHSKLRLYLVALAVVLVAASAAAVMFIVRDGSGLKVRYEVEATSKTATMITWTNGTSSEISKVPASLGETAGLPWSTTVTFKKSQQYVAVAVTLSEPGNATCRMFFDGEKVAETTNPGGVICEGTTP

SEQ ID NO: 14666 - protein, 697 aa, Actinoplanes utahensis
MCRHFVHGGWLLAGAGPLRAGTGEGHASAVVGAPAAVLDVAGAIVRPQLHGEGLAVPRGVEGERVAGAGVGGDRFAVDEQLDPGDAVAVAGGGGHRGASGEFGAVGGCLADRDGGFGVVDDDGPGGGAGLASARRAALRAATPENVTPHFQPHDERKGHLRPSSAAADRRRRPEKRPKVSQHDAFLKTLSRTVCAVTSTILLLAVPGFLTLYFGFFAVFNYTYAFGALTRRRPPTVPLPLDAAVAVVIVSFNEREVIADTVVACEQLTYRNKTIIVGDDSTDPETIALLRTLAQERGCTLVPGARYAGSDIELWESDRFVLFHRAENVGFKAGNLSTMEQYLRQRGFSHMYLLDADWRPQADAVERCLEVIAADPATGYVQAKRLYHYGRSDHFQRCLALNEESCYLSDLPGRQRWNHMVLFTGCCAMFDLRALYAVGGFRAGHLTEDIDLSNRFYLSGYRGVYLEDVANLGEVPPNYQAFRRQQERWAIGSARTFKEYLLPVLRSGLDLRTKWSLLRQNAYYTAALGVELSVVWSLLVVAVAVLGTGPGWPAAEPGELLRVLGYGLGPVMLVTLLSGVAPLVVTTIKKREWINLLYIPVASWIALSVVHTYAIANIKGFRNTAQSWFVTPKTNRKKGAVRIRAGRRMRAFNMVTLVAMTATYLAVYHHTPDPASLALLAVYAALWLPSMAIAAMRS

SEQ ID NO: 14667 - protein, 873 aa, Actinoplanes utahensis
MSGAGGRGLVGRQGELDAVRAALTELGSGAGRALAFVGEPGIGKSALAAAAVSLARAAGVDVVAARGAPVPVPGPRRPVLVVVDDLHEVADAHIDRVERLVAATGAGPVLCLLAYRERQMSRALAAVLAGTVPAGLLERRTIGPLSAEQCRELLGDRPGVEAAHRASQGNPGYLAVFAGQPDAGTPILGELARLDRAALTLVRAAAVLEQPFRPELLAEVAELPVPATLTALDTLMRLDLVRPAEPAPHLALRHPAIGVVVYGRLEPSHRAELHRRADAVLADRAAPIALRAHHVARAADLSRPDDVITLIAAARGMLYGSPAGAAGYLQTVLPLLRDGDPHRHEVQVLLARARLLTGEASEGRALLDALRSAPPRRAPDEAHALVDSSRIERQRGRYGEAAALARAGLAALADRDTGTAAALHTELADHAYNLGDYETSQQHAETAAAIARRHHDPVGEAHALAHAALAQLFTGRQACALRTATRAADLVDAAPDAVLLTNLEAVFQLGMMEGMLGRLANSARHLERGVDLCRRTGQNYIEPAMLTALTNARLRSGSLPQALATLDEPPHPVEWDANAATEAITAMLRAKILFWRHRPGDLAEAVAQADHAVRLAGDTPESWAVTIRCFHAEFVLLTGDPARARWLMLDAAGGADLPKLTAWRRPRWCDTLAEAAAAEHDEAAVRHWAELAEVCLRQLPSTDRQGFARRARMRAHALAGEVDRALAAGRDAITDFSAGGERIEVGRTLLTTAAVALDAGDTGEVAQWLDRAAVLADRCGSARLAEEAATLRGRFTEGGALAHLTSREREVARLASTGMTSGGIAEALFLSVRTVDGHLGRVYRKLQVRNRASLIGALRAGVTPRPRSTPPAT

SEQ ID NO: 14668 - protein, 121 aa, Actinoplanes utahensis
MPAEIRARLLLGRVLVDLRQLDEAAASVGEAKNLADAYGAARLAVLAVNVQRRIGAGRSRGCADVLSEQERRICALVAAGLTNRDVARELYISVKTVEGHLTRIFRKLRVTSRAALTAVAV

SEQ ID NO: 14669 - protein, 334 aa, Actinoplanes utahensis
MRADASQPPLVGRDSELDALITAVATCAGGGSVVVTVGGDPGLGKTALLDELGRLAGAAGLPVLRGRATPVGRAVPGDSPVSRAVDGLRSAAGGRRAVVLCLDDLHAADDDDLAVLSRLLRRPPTGALLVAGAYRPRQVSGALETVLRDTAAGFRTVHLAPAALDQAAATRLFGDGPALRHLAASGGNPLYLRVACELERRGGDPAALPEDLRTALTRDLAPVHGDQLAVLRAAAVLGDPFDPLLLAPVAELDERAALAALDGLAARDLVRSDGSHHRLTLRHTLVRVAVVRRTPPGWWIAANARADRALHRCGAGPLARAPHLARAARPGLAS

SEQ ID NO: 14670 - protein, 905 aa, Actinoplanes utahensis
MAAVVAVDGTQGWSFTEDDTWCHVCPPDGTAVARVQGWKLHVSATRLSVPEVLHRCAGVLVERACAFKFARTAELVAKLTNERYDRAQCGKIITVYPEDDDQLREVAAALDATTAGMRGPAVLSDRPLRPGSLVHYRYGAFQGVRVLTDDGAYQVRLRTPDGRTIEDVRAPRFSPPPWAEPPYPAPAAPPASNGAAGARTVVLGDRFEVREAIRHAARGGVYRAWDRHTETMVIVKQARADVGQRPDGRDARDVLRAEADALDALAGIAPDRLALFDQKDHTFLAESLVPGTTLSAWIHDRLTAAGPMAGPAPADALDMASRLAGLLAEVHRRGLVFQDFTPMNIMVTPDGSLRLIDPELVAVPGAWALRGHTPAFAPPETVDEIGPGRVPQQSADLYALGAVLFVLALGAAPLFGTDQPGPGSTHDRITALITAAAVHNATARALAPAIRGLTADEPAQRWSIERLRAFLDDRAATPTTVLRTGPAEGTTSDRLPAAELDSFARDGLTHIVSTVASEPDAGRLWSSTAFGTTADPHSVQHGSAGVLSVLVRADQLLDRPDLRAVIARVAAWTGRPGTAPRLLPGLYFGRSGTAWALYDAARHLGDADLEARAVDLALALPVRWPNPDVCHGVAGSALAQLRLWRGTGREEFLDRARQAGEALLAGATEADGRVYWTVPDNLDSTLVGITHLGFAHGVAGIGYTLLALAQATGREDFLRTAVLAGDTLAVEVDRKPWGAGWRSDRGDERGTGMQFHWCSGSSGVGTFLLRLWQATGEITYLDLAREAAAAVRQTRWRTGTSACHGLAGNGEFLLDLADAVGGEYRAWAQELATSMVLRHARHGDLRLVPDEGDQDVTADFNVGLAGSVGFLLRLRHGGRRPFMADPSSGRWQVAPASARRPVAAR

SEQ ID NO: 14671 - protein, 590 aa, Actinoplanes utahensis
MSSPATAQVTARISFRFSADGSRAVCMAADERGRHRVESWQLGTVGPRLSFTAPVTGDPRWMMPLPVDADRALLTWFGAGGALTAELLDRDGGRTTLGTFPAPLRVIGAPAATGFPALGWADAPESAGTTLHRLGVGTPWLRPVAEVPGRLRDAVACGDRVLVTTGHGGRSTRMIVDPRDGTCVPAPWLDGLSRVLACAGRRVLATVRRPEGPTVVLADLDTGEPRWSAPGDWCRPEVYPVALDPTGTSIAVVQTRGARSRLLRWDTMSRAAHPVTMPDSDLVPLAAWTPNGLWLPRSGPDRPCGLAWLPPGADRLRVPAPPSPPWSPGRLETFPGAGGPVEAVVHGPDWRSAAHVVVALHGGPASRWSLTFEPLFQALATAGVAVVAPNQRGSTGYGTAHARAIVGAWGVPDLADVAAIGAFLGSRRGPGRPRPALYGVSYGAYLALLAAATQPDAWSACAALAPFLSGPRLHADGHPAVRGMVERLDGLTEADDEIGPRDVARLASGLRAPLLLVHGAQDESTPVAHSRLLAERLTALGRSRGVDLHYLEPPDRGHAVLGTAVQDPVTAVVTRFLAESRPTVAPAPTS

SEQ ID NO: 14672 - protein, 48 aa, Actinoplanes utahensis
MTMTDDLDALQDLPAMEEEEAQAGTCRFTCASTTCKGTCPATCSVTGQ

SEQ ID NO: 14673 - protein, 46 aa, Actinoplanes utahensis
MRVLTATAGMLRVRLTLFVAALTVQAAAGVTVPALLAAASDAVLAS

SEQ ID NO: 14674 - protein, 484 aa, Actinoplanes utahensis
MLTLRRLLALGPRSPFAVGEAVTQVAQAAPQAAALPGHVAEASVSVAGSAAALVALWLVDWRAGLAFTLLVPVTVLAARRFVTEAAEVEGRYLAAQTRMASLLAGALTGARTIRAAGTLAAETRRVAGPLHELSAAGHASWRVQRSAVWKIGLLVPGTEIVVLAVAGVDVSAGLITAGNLLAVAGYLALATGLLDQIDTALSLAQARAGADRLDAVLQRPAVPGGPRSIPPPDGAVSLRGVTVVRAGGRVLDRLDLEIPDGVAVALVGASGSGKSVLGALLGRLADPDEGAVHIGGVDITDLDLPALRRTVTYAFARPALAGRTLHEAIRLGRPELDRVAVESAARAARIHHVIRRLPAGYDSVPARTPMSGGQLQRVGLARALVRPALVHVLDDATSGLDSVTEREVSEAVTARLHGRTRVVVTHRADTAACCDLVAWLDAGRVRALAPHARLWADPRYRAVFETVAVPSAATDREQPCAADR

SEQ ID NO: 14675 - protein, 575 aa, Actinoplanes utahensis
MRRRPVSTRMIRFGLTGPAAALLGDVLRGSGRPLRRIAVLSVAEAAPALASGWVTAAALDRGFLQHRLSVGLAWLAVLAGLHLLRAAAERALFDPLAAVVEPMRDRLTRRVVHHTLLEATSLAAPPDTAGVSRLTSQVDAVRDLTSALLRTARPLAITLLAAGAGLTALDPVLSGPVLAALTVALVAFAWSIRRVGALRRVAVLAAEDVAARVGEVLTAARDITALGAEEEAAALVEADSQRALRAMLSAGRAAASRVPVVLVGGHLPLVGLLLAAPHLIGTRAITAGTLIGAATYLAGSIVPALRMLTSAVGGYWNTLALLLHRLAEVAPDPVADPVPPAPVSPAVRHDTTADLTVAGLTFAYAADAEPVLRDLTLTVPYGDHLAITGASGIGKSTLALLLAGIRQPSAGQVRIGGRPAAGLPEEQRHRLVALVPQEAYVFPGSVRDNLRYLAPSADDDEVVRAVAAVGMTTLLGRLGGLDAELNDPAATLSDGERQLIALARTYLSPAPVVILDEATAHLDPAAETVAEAAFRDRPGTLIVIAHRTGSAARARRVLHLDGDDHTVTEHLGAHT

SEQ ID NO: 14676 - protein, 485 aa, Actinoplanes utahensis
MAGPAGARRDRRPGPGRAGAPRRPAARLGPAARPGRRLRGARAARHHRRPTGLGGRGLPESAESRGGAAASAEPAGHPGRHRAGRRFGLRHAHPHRSGGAARHRRRPPRLPRRTPGRTGRRRHDRHGGHPGGDPVPRRTRLSRRRPPGAPAGGPHDAAARGPHRRRLHRSRPADDRRHRPIAWPIMAHALSGFLLIGVIVLAGWGLRRWGRLPPDAEAVLARVVWLVLNPCLLFTGVAAADPAALFSEPLLVSAGAAVVCFGLFALICRGRSPVVGALAAGYVNANFIGIPIATYVLGDAALAVPIIMLQLLVITPVALTLLEIATTGRASWRGTVTAPLRNPLIVATLLGAATGATGLRLPAVLLDPVTTIGHAAVPMVLIAFGMSLSGRRILAPGPDRRATLVAAGLKTVGMPLAACGLAAGLRLPHDQAYAVTVLAGLPTAQNVYLYGQRFATGTVLARDVILLTTLACVPVLLLVTFLFAR

SEQ ID NO: 14677 - protein, 207 aa, Actinoplanes utahensis
MREQQERRGTGKRAASRLTADDWTAAALEAMAAGGLGAVAVEPLAARLGATKGSFYWHFANREALIEAAVLRWEREYTEGVIRHVDAEPDPLARLRLLIGLVLGATAPDRGGAVELAMLATADHPHLAPVLARVTERRVAYTSALFTALGWPVAEARRRGVLAVTAYLGYAQMAHVAPESLPATEPERLRYVDQVVDLLTAPSRPVV

SEQ ID NO: 14678 - protein, 230 aa, Actinoplanes utahensis
MNVLVVLTSHDELGDTGRKTGFWLEELAAPYYRLQQAGATITLASPKGGRPPLDPKSDEPGSQTEDTRRFAADPAATAALASTVPLSTVDPADYDAVFYPGGHGPLWDLAEDSHSRRIIETTLRSGRPVALVCHAPGVLRHVTDEAGAPLVRGRQVTGFANTEEAGVGLTEVVPFLVEDMLKANGGVYSQGPDWASHVVRDGLLITGQNPASSAEAADVLLALLDERATA

SEQ ID NO: 14679 - protein, 198 aa, Actinoplanes utahensis
MVTTRNLHRDTRTQLLLAAERSFARKGYAAVGINEVLSSAGVPKGSFYHYFASKDAFGEAVLARYFEQYLAEMDEILNAAGRDGASKILAYFASWRESQSLGDCAGKCLAVKLGAEVADMSEPMRLALKAGTTGIVDRLEHAIVGAVADGSAPFTGDARATADALYQLWLGASVMAKVNRSPAALDTATTVTRRLLGI

SEQ ID NO: 14680 - protein, 407 aa, Actinoplanes utahensis
MRWGEQAVTTASSSCTPALTPRPWPTRPGKPTAGSRLVEGTEHRGADGVAVPIDPGAQGEDRNEQVPAGLGQSVLHPGRCLRETAPLHQVHLLHPAQGLGEHLLTDAADHPPQRARPHRTVPQRVDDDGQPRVAEQVDRQPRRTIRFKVSVRREDRPFDARRHVIERATCEAHLGVRIGVPTVGTDTYGQGASMRIGIIGAGQMARALGGGWAAAGHEIMIGARSPQRADELATAIGYGARAGTVRDAARFGEVVLLAVPVAALSEVLAEAGDGAWSGRTLIDCTNAFTPDGAAGETLVLAEDAVAERIAAAAPGTHVVKAFNLCAAEVWLSGQQPIVPLCGDDDAVKLVGLLVSDLGSQPAPAGGLHRARYLEATSVLVVGLWFAGVDARKAFPPLEAAFAVPDSA

SEQ ID NO: 14681 - protein, 187 aa, Actinoplanes utahensis
MAMVSELDFTELYQAHYVDVLRFVRRRASPEDADDIVGETFLTAWRRRADLPPEPRPWLFRTARNIMLNTQRGSRRQQAISIRIAHEPAEPVADAMGPVETRVDLSAAWRELTPRDQETLALHIWEALSDRDAAAVLGCTRATYTMRLMRARRRLARLLGPGAVVSSAATPAPHPTSTLAPTGWEHS

SEQ ID NO: 14682 - protein, 285 aa, Actinoplanes utahensis
MGALVNTDTIALLKSRDGAPARALTREEKARQAHLLHRILTDPAPVRPAAARSRSWAAFWTTAGIGAVAMAAVAVVVTVGPGVLRSPAATGLTTVDVASWTSTSMRLPSAAQEVAAGPRDWCMKNTVGDPNSTATRTVVSAELRGVVGSLIMKQGDDYSLCMAGRDRSGFAELLDAPTPLLDAEVRPMTGGGHGDGKSAFSYVVGRAGDAVTRVTLTVGARTVDAHIEAGWWTAWWPNPEATGDRPEPEVTVTVTVTLRDGRSRTAPLSYDQPSAGPQPSATASR

SEQ ID NO: 14683 - protein, 268 aa, Actinoplanes utahensis
MTPRPVRVLTGLLIATAVATVAVETVNFSSAPEHGVGFAVRTGWALVRTLGWLILISQVRKGRATARPLSVILAMTTLFAVGRLIVSPSGLVGFGVLAMLWLTVVALLHRHRGIGAHLTHLPRRPVLTREGLSLREAPPGDPWVLTARLAAFSYSPLMLVPALVAAGTLGHRPEWAFPVILWILAGIAVSYVALLSAFLLARGSGRARRTLVSVTIAVLLFDLPLCRLLLGTDGLIRDGAPLVAAAALTLYALRRAAASPRVLLDDHC

SEQ ID NO: 14684 - protein, 262 aa, Actinoplanes utahensis
MSDPDAYYLPAGDGEFDATTATTSPWDDAMQHGGPPAGLLARAVELTRPDPEMPIARLTVDMLGPIPRGRVRTEATIVRPGRRVEMVEARLWAGGRLAVTATAWRIRTQKDLTRRYAVPVVPPPLPAAQAAVFFPGVDPAWGYGRSIEWRFVAGSFAEPGPVELWARVRLPLVAGETPSPVQRLAVLADSANGISGELPLTGWLFIPPTMTLTIARVPEGDWVHFAARTTIGPSGTGIAQGVLSDPDGFVAQVGQPLLISPR

SEQ ID NO: 14685 - protein, 682 aa, Actinoplanes utahensis
MHPWIRRRVAASAVLLTIGLAPAIAPTPAAAATADTHVDVDTRAGLATVAGTAVGVNHAVWDSQLGTDAVADLLHDAGVGMLRYPGGSYADIYHWKDNTAPGGYVAPGTDFDTFMAGAQRTGAQPMIIANYGTGTAQEAADWVRYANVTKGYHATYWTIGNENYGNGHYGSAWEADDHADKSPKEYADAVVAYAQAMKAVDPTVKVGAVLTMPGNWPDGIVGAGDSGTWNQEVLTRAGTAIDFVDVHWYPGGTTPAEALGKPAQIQDAVYLLRRQISRYAGADSSRIGISMTETNVDAGRNTQPGALFLADVYSGLLAQGVFTVDWWNVHNGPDRAGTIAGQTDFNDFGLLSSGTCTPDNAACEPPLNTPFPAYHALSLVGSLAHAGDRFVGTASDNALVSAHAVHRANGDLAVLLINKDPDAAHTVALNYQGFTPSAAVPTVSTYATGATRVTSGAAGTAGTQVLAPYTVDLVVLHPDRVDPKAPKAPGQPAATATDRTATISWPAGGGGLKYEVYRQNRGVSALLGETTGTSLTVHNLEPGHRYTINVLARDGAGRLSPPSPPVTVTTGAPTDAACTVAYRDTNDWGNGFVASIDVTNNGAGPVSGWTLAFTWPTGWQSVSSGWGATWNSDGRTVRVTSDATLGAGASGNVGFVGAYSGPNVPPGVFTLNGTVCGVTTAG

SEQ ID NO: 14686 - protein, 151 aa, Actinoplanes utahensis
MGMTSGEGRGAQLLPVLGQLVRFLRQLEGPDNPSSIALAVLRRLADHGPGRVTDLARLTRASQPGMTQLIGRMEKAGQVRRVPDPHDGRGVLVEVTDAGRELLSRTYAYYATTLDRLFEQLTPEESDTVVAALPALERLARAGERESAGTR

SEQ ID NO: 14687 - protein, 583 aa, Actinoplanes utahensis
MGGRRGRPAGRAGLPGHAAPGGRHAAVRPRADRAHHAVRRGPGAGGGTGQAGFRRRRRAAGRGAGARAGRPGDDRPPLAARGLCGDRCGDRGEGRRGDQRCAVPDARPPHRARLSPEKSGSGPAGGRCTGHADPGGDREAAVLPAKEGLMAVSVFDLFSIGIGPSSSHTVGPMRAARMFLGHLDDRVATVRAELFGSLGATGHGHGTPRAVLLGLMGEDPETVDTTLEPPASLTMDDRRVEVDLVLHRRRSLPEHPNGMTFTALDASGAVLISKTYFSVGGGFVVDQGTSRLRADETPLPHPFSSGAELLALTQRTGLSISRLMLANETAWRPESEVRSGLLAIWDVMRDCVGAGLDAEGVLPGGLKVRRRAAATARQLRAAGDPAVHAMEWLTAYAMAVNEQNAAGGRVVTAPTNGAAGIIPAVLSYYTAFIPGAGPDGIVRFLLAAGAIGLLFKENASISGAEVGCQGEVGSACAMAAAGLAEVLGGTPEQVENAAEIGMEHNLGLTCDPVGGLVQIPCIERNGMAAVKAVTAARMALRGDGRHHVSLDKVIKTMKETGADMKIKYKETSRGGLAVNVIEC

SEQ ID NO: 14688 - protein, 92 aa, Actinoplanes utahensis
MTTATIGASAACDKGGPKVADTGAGPNWICMMSFTDLHGQHQDGKFEVTVKTDGTYVAGGPSKIIGLATVTDTQGHDVPKPVFEFDGVLSTR

SEQ ID NO: 14689 - protein, 100 aa, Actinoplanes utahensis
MSGRDVAPIDGGGLPVRGPQERIDALIAAVVGAGSRGAARPTGETPSVHRAADRRAGGQCRPDPDLPDRGVPDAAPPRHHRRMTMRPAITRAALVLAVPA

SEQ ID NO: 14690 - protein, 776 aa, Actinoplanes utahensis
MDETPTDLDALHEIARRVLWLSASIVDAANAGRPNDSGVKVGGHQASSASMVDIMVALWFAELTSRDRVSVKPHASPVLHAVNWLLGDLDEAYLPTLRAKGGLQSYPSRLKDPDTVDFSTGSVGIGATAALWAAMAHRYVASQFPGTAPGGRFISLLGDAELDEGAIWEAVMDPAVAKMGELLWVVDLNRQSLDRVVPDIQITKLQGMFAAAGWQVVILKWGRIISRLFDRPGGQSLRARLEAMPNEEYQRMLRVGPAEVAERILAGSSSLADGHELKALLDEIPPDELAAAVRDLGGHDLGLLVDTFHGVETHRPTVVFAYTVKGRGLPTEGHPNNHSALLSAAQMDALAQACGMDRRAPWQRFGPDTPAGRLCAARGRALRREPVAPTSPLPVPVQLDHGYRKPMSTQAALGRLLADLPRDAPEAAARVVTCSPDVASSTNLGGWINKTGVWSVEDRHDWFADDAERVLRWREDSNGQHIELGIAEVNLVSLLGELGTTWSRWGERLIPIATLYDPFVSRALEPWSYGIYAGGQSILVGTPSGVTLAPEGGAHQSITTPSIGLEQPGCVAWEPAFAQDLQWCFLHAMSRVGVEGGTSAYFRLSTRPIDPGLARVPEDPTLRERRRRQSVAGGYRLPADHPIGDEEVTLVGVGAIMPEVVAAADALAAHGVKAGVVCLTSPDLVFRSFQQRGSRAAGVGGGILDELFPAEHPTPLVTVQDGHPHTLAFLGAARGDRMRCLGVTEFGQSSGLADAYRLHGIDTGSIVDAALTLTRH

SEQ ID NO: 14691 - protein, 643 aa, Actinoplanes utahensis
MRGGVFRQRRELGTVFRGDQVPKRVRVCDAGDGGFTMLEMIVSAAVVCVVLMGLSTFFVQAMSTSHGQGQQQGGIRLAADAMDTLRAPQVTALLSERAPCATACPAPVAKAVPLLADTERWDAAAVPTAVTTAPSTATGGIAFPVPPSSSGIAVNGVTYQRYLYLGKCWEQTGGSPCTADNTQPIAMVRAVVGVAWPSPACGGDTCSFATSTLFGAGGSGDPVFGSGAVAVTAVPDQVSTLGSAIAALPLSATGGSRPYTWSVTGLPNGLTFDPTTTSVTGTPTSAGTSTVTVTVIDARGKTARITFRWAVVTKITLAKIADQGTTQGRSVTLSPSAAGGTTPYTWSATGLPNGLSIDSATGVITGTPDTLGASNVTVTVTDARKQNAKVSFVWTIYSAPKLAIPPKQDTYIDTAAVPLQMVATDGVGPYTWTATSLRAGMSIGSSSGLITGTPAALGTAHVVVTVTDSRGESASVTFDWSIDKAQQLNDSTTTQLIVANPSLYTWGAVNLPPGLSINSATGLVSGTPTTAGTWDIQILLTDASGTVKKIPFKWTIYAPLTITSPGAQSSQKGKAITALQLTQTGGVGPFTWTASGLPAGLALDANTGVITGKPMTVATSTVSITVTDFAGNRKTIAFTWQVS

SEQ ID NO: 14692 - protein, 225 aa, Actinoplanes utahensis
MRNRTPIRARRALPGGDAGVTMIDLMVAMALMSIIGAIATGGLAQLYRMTDATDRMDEAQTQASLAYAGLQPEIGVAYDISDPGAGAGGDPSVEYVTQDSSGQRVCHQLRLSGGTLKLRQWPASATTVSAAGWRVLASGLAAPATPDADTGAAAAPQTLHFPDFSTPSLTNLPSATPLQLRIRLTATASGGKGSTQRDTQTTVVAANSTVGWHDPVACSLGRNTP

SEQ ID NO: 14693 - protein, 514 aa, Actinoplanes utahensis
MSAPRHPRPLPAAGDRGSMPIALLVTMVATSLSVVLSSLVIAQIGTTRFDQRRVSGLQSARAGLQAAVATIQASTSGGVSTVTLSTAAGNPQGDRTKLPCAPMTDASSAGPATYAVSFDYYTTDPQYGGSPLAPCQTGQGPGNQAAYVRLTSTGLDLAGKVSVTLTATYPLLSGDQNLAGDTVRLAGTNLCLDAGDTPVAGGQLALRTCAASTRPKSQLFAYGSNLQVRLVSSSPPDGLCVDAQQTSGSSLALAACGTTTVPATQQWISASPGPSGGGTWASSARTLCWRAAGPVAGLSVNLDADCSTASTFVSRGSAGAGAAVLADRNQWVDYAEFSRCMDVGGQKVADARLITYPCGQSPSLTSADWSQQWVPVDATSGQAAVLANGVAGVADVLFTVTDNDASPTNPDGRYCLWSPGTAGQKVQAKACSTTTAGYRWTITRNTGLPTTSYRVQDDHALCLTAVGQDVLVDPGAPANTSILRTMPCDGSDQQKWNAPSTAQNASPLLNVTQR

SEQ ID NO: 14694 - protein, 57 aa, Actinoplanes utahensis
MGAAELGRELGDAGGPLLVGAIATATTLNGGFAVLAVLVGALAAILPALPLRHVQQR

SEQ ID NO: 14695 - protein, 265 aa, Actinoplanes utahensis
MWPLYAAGFTTAFGAHAIAANLGGAQVSLLTLGGLLALYDGAEIVLKPVFGSLADRIGPRPVLLGGLVAFALASAVYVAADSPGWLWAARLGQGAAASAFSPAASALVARLNPGAKHGRAFGSYGFYKSIGYTLGPLLGGVIVWAGGLRSLFVVLAGLGAAVAVWALLAVPHLAPLPKTRQTLLDLARRLTSATFLRPTSALAAATAALSVGVGFLPVTGRAAGLSPIATGAAVSVLALCAALVQPRAGRALDDGRLSLRTGLTA

SEQ ID NO: 14696 - protein, 111 aa, Actinoplanes utahensis
MRVLVVEDERRLAELVARGLREAGRCAGRARRSVTARAAAGRGMPARHTAEVRHTGDDELLALHRHSHESAVAVLQAGDLRLDPGARRVFRDGAEIELSAREFDILALLII

SEQ ID NO: 14697 - protein, 106 aa, Actinoplanes utahensis
MHTKESDYHRSGPGVSSGTTGPATRPGCIAGRMPAAVNSRSAATRGRSAGSAAKWWPRRAGGRRGPGRPGTTRLPASSSWKVVPGLTGGGPPRPTAVVSCSAWALR

SEQ ID NO: 14698 - protein, 63 aa, Actinoplanes utahensis
MVPGLPGPRRPPARRGHHLAALPADRPRVAADRLFTAAGIRPAMQPGLVAGPVVPLDTPGPDR

SEQ ID NO: 14699 - protein, 667 aa, Actinoplanes utahensis
MSRYPTLLSPLDLGHTVLRNRVVMGSMHTKLEDREQDLPKLAAYFAERAKGGVGLMVTGGYAPTWRGWLAPFGSKMTSGRHADKHRVVTDAVHEHDGKILLQVLHAGRYSYHPFSLGASAKKSPITPFRPRAMSARQVDATATAFARAARLARRAGYDGVEIMGSEGYLINQFLAARTNDRTDAWGGSAAKRMRFPLEIVRRTRELAGDDFIVQYRISLLDLVDDAQSWEETVELARGLQEAGVSLFNTGIGWHEARVPTIVTSVPAGAFTWVTRKLRDEVTIPVIASNRINRPEAAEQILAAGDADLVSMARPLLADADWVVKAEQGREREIITCIACNQACLDHTFKNTRASCMLNPRAGHETELVLLPTRTVKRCAVVGAGPAGLAAAVELAGRGHSVELFEAGESIGGQFRLAARIPGKEEFARTLDYYRHMIDVRGVKLHLGVRATVTDLAGFDEVVLATGVTPRIPQIAGIDHPSVLTYQQLVEGAPAGERVAIIGAGGIGFDIGEFLLHDQNEPLDDWMRRWGVTDPAAERGGLTTAVKPSVRRKVYLLQRKETALGKGLGKTTGWVHRATLQQSGVTMLRGVSYQKIDDAGLHLTVGEKAQVLAVDTVVLCAGQDSVRDLVAPLTDRGVTVHVIGGADVAAELDAKRAIKQATELAASV

SEQ ID NO: 14700 - protein, 270 aa, Actinoplanes utahensis
MGYVSLTIDNGIAQVRLNRPEKLNALVLDTLHELIAVARRLRRDRSVRAVVIAGEGPSFSAGLDIAGTLKSPARVVRAFVPVPWRGTNLFQEACWAWRRIPVPVIAAVHGHCYGGGIQIALAADLRFATPDSQWSVLEGKWGIIPDMSGIRSLTEVVGLDVAKRLTMTAERFSGARAAELGIVTELADDPVKAATAFAESLLAKSPDAIAAAKRLLNGAVTSSARRTFARERWEQIRLLRLPNTAILRRAVLAKATPEFRPRARRMRPWH

SEQ ID NO: 14701 - protein, 184 aa, Actinoplanes utahensis
MALRNAVLAALIDRESSGYDLAKRFRVSVANFWTATPQQLYRELDRMESEGLLAARLVKQDRRPDKRIFSVTEAGRAALLDFTRQEPKPTTVRDELLVQVEALAWADPASVRSSIEARIEQSRRRLTAYEQMVVEILGSRSHAEFLATGNRIGPYLTLQRGISFERENITWGELALQVLQSRSM

SEQ ID NO: 14702 - protein, 503 aa, Actinoplanes utahensis
MATKKHARRAALTVAAATATAVSLAYPIAAGAAPGVPVSVLADTPGTAKPVTKAPTATAVTPPSGTTAGGTTVTVTGSGFSSLDLTNPAAVKFGDLNAASFAVVSDTRLTAVTPAGTNGAVKVTVTNTVGSSSGTVSFGFRAPLGARFEAVTGAKGGTVVPVTVTGGTVGATAAAFTTEKVTAKVGDATATVAWTDEAHVKVTVPAGTKFGAMKLTLTHDGVAGTPSESTIRYAPLLSGVLPAKVSTAGGETVTITGNGFTDVASDDPASVTFGGRNATSFTVKSATQITAVVPEGANGAAPVVVKSAGGSVSGTVTYRTPLGLEVPAGAVAKASGGTVTLTVTGGTVGATPKEFGTQAISATVGTSKVVPVWVDATHVKVPMPASAAATAPVTLLHDGVPGKPVTVSYAPVVVNLSATTDTLAGGTKVTVKIAGGELGGATGFTFGGKEASCTRQGTGTFVTYLCVTPPATTAGPVWVSFTASTGTASRFTPAAVFNYIDLD

SEQ ID NO: 14703 - protein, 330 aa, Actinoplanes utahensis
MIVEVREGLGHLVLNRPRAINALTAGMVAIMRRALAGWAASDTVRAVLITGAGERGLCAGGDIRAIHADAVSGGSGSIRFWADEYELNATIAEYPKPVVALMDGLVMGGGIGVSAHASVRVVTERSRLAMPEVGIGMHPDVGGSWLLSRAPGELGTHLALTGSAVGAADGIAAGLADFFVPSERLPALVAALEQGQGVRAFTAEPPPGEFATAREWIDVCYRGDSVIEIVDRLARHPAPGAQAAAKEIGTRSPTALTITLRSLRTAARLPDLRAALGQELRLSAAMLRLPDLAEGIRAQIIDKDRNPRWRPSSLAEVRPETVDEVFEATR

SEQ ID NO: 14704 - protein, 192 aa, Actinoplanes utahensis
MSVTERKQRERAVRERLIVATARELAEQMGWEAVTTRRLAERIEYSQPVLYSHFRGKREIIGAVALQGATEMAAHVRAATDATDDPRARVTALARAYLDFAARHPAVYDALFLLDGGLAYGRQDTPAPLRDAFAALRETLGEVAGDGVDKGLFTEVFWSSLHGLATLTRTGRLLPAFAEARVELLVDRLAVL

SEQ ID NO: 14705 - protein, 148 aa, Actinoplanes utahensis
MLNALEVITTVVVGLMVGVEFSVAFVMNPILDALPEDSGQLGHAHGGRMLGRLMPFWYIGSVVLIAIWAVAGRRHDGDGLVVTAAGLLIVSVLMSVLLLVPINNRNRTWTPETRPADWKQQLNRWLRYHYGRLAVILAAFTVLVTALV

SEQ ID NO: 14706 - protein, 428 aa, Actinoplanes utahensis
MNDWVEHVIWWHAHPLTFLGAERAALPPDAAPVPRLRRFAPWLDYLVELGCNGLALGPVFAAETHGYDTVDHYRVDPRLGTTDDLRWLLDECRRRGIRVLFDGVFNHVGRGFGPFRDVLDRGRDSAYANWFRLSYNDDGGFDHADFEGHHHLVALNHDEPAVVDYVAGVMRHWREFGADGWRLDAAYAVPLPFWRATAGSIDGGWFVGEVIHGDYPAFVRDGGLDSVTQYELWKAIRSSLNDLNFFELAWALERHDAFGADFPPLTFVGNHDVTRIASALTEPRHLGLALAVLFTVGGVPSVYAGDEQAFTGVKRDIEFGDDEIRPAFPATPADLAPFGEPTFHLHQQLISLRRRFPWLHRATTKPLHLTNKQLAYEVSAGPDRLIVLLNAADHGHDFPLDLGPARVVESSGGTGTLVPGPGWSILRG

SEQ ID NO: 14707 - protein, 403 aa, Actinoplanes utahensis
MRVVLSTWGSRGDVEPLAALAFQLRAQGAEVQVCAPPDEEFTTLLNGVGAEHVPLGPAVGSVVAGSRPPSAQDAFRLAADLVAARFETLGRVAKGAEALLATGLMPSGVRSVADHLGVRYAMACFHVYGLPSRHRRPGTRPGVQSAAQETDPRVLWKEDADRINALYAEPENRHRAALGMPPVEDIRSYVFTDRPLLAADPVLCPWADTTDLDVVQTGAWIRPDDRPLPAELTAFLDAGEPPVYVGFGSIASYLPADIGRVAVEAIRARGRRVLINRGWAGLSALDDGADCLVVGEVNQQALFPRVAAIVHHGGAGTTTAASRSGTPQVVVPQIADQTMSAERIAELGIGVAHEGRSPTVGSLSAALATALGADVRARAAEVGGTIRTDGAAVAAGMLLSGEF

SEQ ID NO: 14708 - protein, 139 aa, Actinoplanes utahensis
MERGEVWWAEIDGKQPVVLLSGGPGPAFAAVQVVEPATPAQKIGFVLLSGAQAVDADERCRILAAAGPDTRAGGIEVFLGAEEGLPRSGVVRLALPREGKVFCTWEATVSVDSLVERIGTLSPAKLRELDTALALAGHR

SEQ ID NO: 14709 - protein, 509 aa, Actinoplanes utahensis
MDWPPSPSPLRPAVPAPGPARPRWPLSPSAPALRSGRPSATPRGPPRATRSRSTRTPPAVTGCSPSSTCSATAPPSPAAPGTSGRWTPPGWPRSSTGSGWTRTTGRTPPRRPGTSSGSSATTRAPTRRVTRSARTGTTTGCPWRPSGRRGSTTRCAPTRPGSAPTRTPSRPPTTWSASGTDRRPAPSGDICRDEQDGNLYSASMVTKLDLVCAALDALFDLDTAAPDAAMSRHVPRVYDEAGVDWRAFVEPRFAQRFNGLMHRGHPSVGAVHGACLPSAQVLDDWLSVARTGDLLITHHPIDIRNGSPEHDTWAEGFVPIADAHRLAIVERQLSMYSCHAPMDTSVRVGTAAAIVEGLGGTAVDYFWPYDEGYAGHVADIAPTTTDLLVRRARELFGLDLVEVEGRSRDDITRIAVVGGVGDHVDQMAEAERLGAQAYLTGELHVRIEGDYGRRKFADVQNFAATTGMTLIGVSHAASEHLVMETQLARWFTGTLGLTLHPIRETDWWR

SEQ ID NO: 14710 - protein, 261 aa, Actinoplanes utahensis
MDLGRRRDRDDYARRMAYASPGGMIARATAARLAGDWRAACAAAMVDVRFEPAAVRDRFGAAATAAIEDDLAGLAPDLLRRHLPVDTWGRWPSRARVVLSSRPEPFRERRFLARRRPRVPVLVATLPRDGLVARRVTLEVVDVHELSGVWVDLPAWAWHADAIEGRRWAYGASAARLPWHFADGTAYPQGTVTDGTDRAGEFERLLGPIDQDRRTEWYAAAGIAVPDPHRDAWIVQRLAGLQDRLPVAAAEARRLIERLAS

SEQ ID NO: 14711 - protein, 197 aa, Actinoplanes utahensis
MIGPDQLHPLVHEALFPGRVQHWQPIEHRPRRTFRVLCGGRWHPVEAAGASLRILHPDHPVTPNGCTAAVDRFRTAGAGTPKKVRRLRQRVFERIVHGDTDAVLADLAAGCDPLLRDQHGRTLLHYIANVEHERVLPVLLAAGLSLADRDYDGRTPLHVAALSADTGAMAALIAAGADENAFDGRGSTAAQVRRVGS

SEQ ID NO: 14712 - protein, 422 aa, Actinoplanes utahensis
MDRADLDAAVAALARLDDPELDPASRLELERAVTTAARRIKQRAKARRSAQSRDADRTLLAGASRFRTEIPSPEPVAPAAPAETLGVLRRVRLCYVCKGDYREVDADYHQMCPVCAAENRDWRHARTDLTGRTAIITGGRVKIGFHTALKLLRDGATVVATTRFPDDAAQRFAALSDFDQWGDRLHLHGLDLLDLDALQEFVRFAGRRFDHLDILVNNAAQTVYRPPAYYRSLGTAPELQALDQRFFPAGRVDETGFQLDLRPVNSWVLRDGEVSPHEWLSAHVVNAFAPFLLTSRLRPLLAAGPPRDRHVVQVSAMEGSFSRTGKTVRHPHTNMAKASLNMLVRTSAPDYARERILMNAVDTGWVTDERPHPHKQEQRAIGFRPPLDVIDGAARVYHPVVAAGRGAPISGKFLKDYRSVPW

SEQ ID NO: 14713 - protein, 382 aa, Actinoplanes utahensis
MSAVDAGDRADVRVRGGRGTVGEQAGGAAPLFAGNAAVDAEVFQGGMPVGDRVDQQPGAAAADPGPAQVEAAQPGGGQRGREGGGALVAEVVGGGAEGALGRWPAQVQNLPGGAVAGQGRGAGRGDPVAAETQDCRYAVSSLAERGGAPVAQMVGGQVQLVHAGLVDQPGQHADGVRAESVAAEEQPLQTGAAGDQGVGQHGQAGHGEPGVDQIERTQDRVAGERRREPRDALVTDRIAFEPEGADRVVGGQPLGEHRGTVRADPVAAQVEGFDAVPGPQRAGDRLDALGAQRVGAEQQVPYVRGAGGRGGDPAHLDRADALLAQVEATVLPDRPAREDSRAGRALGEPADQRVEVGGWGEAVVRVLDRRAADRHGHQGTLR

SEQ ID NO: 14714 - protein, 375 aa, Actinoplanes utahensis
MTMPIRCPAIQNPDDGLAPPADFDPLVSWLAEGPAGPAVFPRGAVRQDGRLDLCKQGVGPVEVGRIAAAAAGSPHVRHLLLGTNALGTEGVEAVAGALRPGHGIETLYLGCNRIGPDGAAVLAERLAADDTVRALWLKRNPVGDEGVARLAAALAGNPILRTLDLVNTGLTVTGLTVLTDALVAGGARLQRLFLGGNGLGPDAVGVLARLIHEAGVHELYLAANHLGDRGAAALGEAAHGVPAILGLGGNGITATGAAALARDCAAWQILDLSRPPSERALGATANDLGDEGAAAFAAALPTARLRRLDLRRTGIGGRGARLLVDAIADGHPTLEYLGINGGVPRKQRRRAAGLLADRPSTTPHPDIRAIASIYR

SEQ ID NO: 14715 - protein, 150 aa, Actinoplanes utahensis
MWDYPRPPRVERTAARVTIVHQGRVIVDSDRCWRVLETSHPPVYYVPRGEIAAGVLEPGEGRSFCEFKGIAAYWDLVGDGIRVPRAGWSYEDPSPGYAVIAGAVAFYPSRVGECRVDGELVRAQEGDFYGGWITADITGPFKGGPGTTGW

SEQ ID NO: 14716 - protein, 68 aa, Actinoplanes utahensis
MARAPPAGDGARLTFPGRIRSGPVAPNEGSVTTDDDSKGFVPPQPIEFAGAVPWTPPAGFAGPVPARA

SEQ ID NO: 14717 - protein, 140 aa, Actinoplanes utahensis
MFAGAGLLAGLIAGVGLAVGPLHDPLASLSSKASSESPRPTAAPSGRGPVVPLGDALTLNLADGHYLKLGIALQLAAGQPDSLDVNKALELAVDNYTGQDLGELSTAQGRARLKQQLLEKTQAAYPGVVSDLYFVQFVTQ

SEQ ID NO: 14718 - protein, 524 aa, Actinoplanes utahensis
MTLTIRRQIAALAVAGFLLVAVAGAIGYLGTSALDEQQAVTRNAAAALQAAQSADIARSLFRGSVLAALVTNDAKERQEVLDRLGRNVRQVRQGVDEVIRDMPQVRPQADAVLPVLNQLIASGQRIVTLASRVASDPKRTAALAARPAYDAVDVKAAQAIGALQAAINERMKAAYDDAAAAAKRSKTLTVVVGLVAALLLGGAAMLLARRIAQRVNSCLSAARSIAAYDLTVEARLGGSDELAQLGTSLNEIVSALRTAVSEISGNASSVAAASEQLTATSRHLAEGAGTASSEAAVAKQDLEQVTSSVHESTRAARGLGSSIQAITTAVAEADTVARDAVGLASDANRMIERLRSSSDEVSAVISIITSIAEQTNLLALNATIEAARAGEQGKGFAVVAGEVKDLSRETATATGDISSRVTAMQTDTGQAFDAIGRIGQVISRIDELQQSISTAVEAQTSATDLIAGNVEVAERSAAAVSASIGRVTDTTVLTHEAANQTEAAAVELAQLSHQLRLVSDRFQL

SEQ ID NO: 14719 - protein, 282 aa, Actinoplanes utahensis
MGRLARLLLPALLVATGATGCGSATGALGQPVDRLAEARAALPPGMADGGVLVAGTDPTFEPMTFKQGSTYTGLDVQLVEAIAARLRMRVDWRTVSFGDLLDQVQQHKIDLSVSSMFDRAERQKKADFVDYLNAGTSIVVAKGTGDVGGMPGLCGRRVAVQPDTVYVDMAAAQAARCGGRKLVSVRSDNPSAAVAQKAADAALNDFPIAALDVQKNPGLELSGPQIEAIPYGIGIAKDRPALTTAVQTALYSLVDDGTYDALLTKWKVTEGALRTGAVDGGA

SEQ ID NO: 14720 - protein, 236 aa, Actinoplanes utahensis
MPIDPSKAPASTSPLWIIALFIVLSEVMAGVASIATDGATRIIFAVFAVGFPLIVFAVFSYLLVGHTAKLYAPSQYSVDIDPERFAVGVNAGGFTQPQVTLIAEAVAQAIEQSEPASHGDANVASRAVEVFRQTIFQSSVAVDLDGIGDGGSDGLVIPVDRGTGVDDFLDQVWFAMRGRFRAFTYGKDWVLVDDENRKEFREAGTAWAQKHGETRDRRPLSEIGISPGSNLRVVAL

SEQ ID NO: 14721 - protein, 140 aa, Actinoplanes utahensis
MIEPTVAVRIARPSRDLAAAERFYVDGLGLTVIWRTTGDLQPGEHDLIMLGWPGATWHLELVGGPNLTVEPSPTAADLLVLYLAGPVDEALIARLERAGGRRVAQGGYWDRWGVTVVDPDGYRLTLSTRSWSNGTTTPQP

SEQ ID NO: 14722 - protein, 187 aa, Actinoplanes utahensis
MGKLTYGMNVSLDGYIAAPGGDLGWGAPSDELFQWWSDRVAATGLALYGRRLWETMNAHWPTADRRPDATPAQIEYAGRWRAMPKVVFSSTIGAVDGNARLVTGDAVAEITRLRAGDGGPMDIGGATLAAAAVRAGLIDEYVLVTAPVLVGGGTPFFTALDSWVNLNLVETRAFPGGVLLTRYETRR

SEQ ID NO: 14723 - protein, 93 aa, Actinoplanes utahensis
MGMYTHTQRVYARTYGRLARLPGRDGAGGDDPRMAAARDRVIASIGYRAFLGGPPAIGFLGHHVGVLRALIVVAALPALAVPIAGSVRPAHRD

SEQ ID NO: 14724 - protein, 582 aa, Actinoplanes utahensis
MSPVPRRRLLIGALITVLVAAFAAVFAGPAQAADQLLSQGRPATASSAENADTAAAKAVDGNASTRWSSAFSDPQWIQVDLGAAATLSSVTLNWEAAYARSFQILISTDGTTWTTAYSTTTGTGGTQSLAVGGTARYVRMNGTVRATAYGYSLWEFQVHGTFTASGCSANDSARGATATASSAENADTAAAKAVDGNASTRWSSAFSDPQWIQVDLGAAATVCGVELSWEAAYARSFQILISADGSTWTTAYSTTTGAGGNQSLTVSGTGRYVRMNGTVRATVYGYSLWSFVVHTTTGGTGTPPGGTTMPDSFWGDTSGIPAAGNVLQVKILNRTNGRYPDSQVYWSYNGVAHSIAEQPYFDMPANTAGRMYFYLGSPNSQYYDFIEFTVGPDQFNGNTTRVDAFGLKIAMRLHSHDGNDVQVGEDYQTFTEDRAVTFQKFSDEVPAEFKHLATATAPYRILAPGSDAAFRQGGQYQNYLSGYAAQNGITAITSDIFGCAGVLAGQPQQCAALNRHTIDLPQAQWETPSNFYRAAPANYYAKFWHDHALGRLAYGFPYDDVAGQSSFVSHGDPQYLLVAVGW

SEQ ID NO: 14725 - protein, 266 aa, Actinoplanes utahensis
MSGRPLAPAVVIDKTAAVRRRAVLTTLAAAAGLPVRPQPQPVGLQLRYKHLGDAAQAIIVSGESWTSTYATLRSFQRDSDGRWQVAYPAMPARTGYGGWAWAAKRVQDRGLTPAGTFTLTEGFGVQANPGSRLPYRKVDGDDYWAGDKLDPATYNIFQPSAPTTRTWRITESERLADYPTQYAYAAVIDFNRPAGVHWDASHGQNVTATPSHVGAGSAVFLHCSGAGNTAGCVSVGKDDMVTLLKWLDPARHPRIVMAPAADLHSA

SEQ ID NO: 14726 - protein, 473 aa, Actinoplanes utahensis
MGPGVADRPVTRHAVQDRQAGPSRPAPTAHGSPRHIPDEPGEPGVAVRRTGAPVEAVAEPIVEPPGTGVGLPHLGVGRPQAATPPAVGTHPVQRLPDTAPLMVRPHLDLPQLADPRHVGGRVVRRADQRHADHLAVVLRDQQLPARVAEDRRHIGAAHHHRPCRQLRSALHVPQDPVARGDMHPGHRIEIPHPRRPDHRLRPDALPADSHDPSLSRQDIDTVKLLVVRVKVPRVITDGVHVHVSNAAAMWRVLVPGARELGDHLRADRAPATRLLVTRPLPAAAVAALLATVPDGRPVTVEDTFGAEPAEAAGATVRRMPVMNRPAGPPDPRNAPDVRVTPVTAADELAVAERIMVESFPMSEFLPLVRGAALPERLLTAPGWQVWLAYLGDRPAAAAYTFDDGVAAGVYWLATLPGFRSRGLARALLATAIAAYPTRVFTLVATAAGIPLYESLGFRTVGTTIWYRSPGAAR

SEQ ID NO: 14727 - protein, 84 aa, Actinoplanes utahensis
MEASGDGTGRLARTWVLTRKEFKSRTAETSTELPWSAFTWLWQDDDAYLLRTGDGKTWDIPREPLTAEQDAVLAGFLDGLRRAS

SEQ ID NO: 14728 - protein, 129 aa, Actinoplanes utahensis
MPVELNHTIVHARDSRESAEFLARILGLEVGAEWGPFIPVTTGNGVTLDFAAIPAGPIATQHYAFLVSDEEFDAAFMRIREAGVTYYADPHLKQPGEINHHHGGRGLYFKDPAGHGMEIITQPYGTTVN

SEQ ID NO: 14729 - protein, 153 aa, Actinoplanes utahensis
MEMAVREGGGAGPEFAGPDAPCLQLLTLSAQVLDGPALTVGTYQDDDVFGLLLTSPEDGASSRNGIFRARSLPELPVGPVDEVTVHLDADVLAEVVLRIGERNLLLIAGEAYENGDGDLSWHRLDESVLAFVDPEAAQALPWIPRRSTPAGSA

SEQ ID NO: 14730 - protein, 106 aa, Actinoplanes utahensis
MSITAFALLRPNGPANPPAAPPSPAVSPTPSALPTSASPPAPTASSAGRVPSSSARPASPTALAVTGPGVTAPAGTTPTPSAASATAQPTPTGSGSLSTVASTPKR

SEQ ID NO: 14731 - protein, 94 aa, Actinoplanes utahensis
MAITVALGVVAGLAVADADVAGEAITVGEVAGAGFLSPAKAAAADTPPIAATATAPAVTTRARVDLRISSSSTVGRCTVAWEDASAQKRLAIMM

SEQ ID NO: 14732 - protein, 343 aa, Actinoplanes utahensis
MSAVESLRFARAEDGVTVGYQVFGRGPALVWMPSLSNIVAQWRIPVMRAAYRGLAERVTLVLYDGRGTGSSDRRIDLTDLGVDAHLRDLRAVLDHAGIARASLLGYYHSVTTALAFAAREPGRVERLVLFGGSPRLREAMLPAQTRALLSLIEQDWDLFADAAAAAWLGWDAAPSNRWTAEAFRGATTAPVAKAWFEAAGEIDVSDEVARVRAPALVLHRQGEQQIPVEVFRRLAADLPDARLVELPGSTPTLFMEDPGADLRLVTDFVVGGRAGAFRASPGLTAREGEVLALLAAGESNSAIAGQLGIAVHTVERHLGSIYRKIGARGRADAVRLAVSRHPR

SEQ ID NO: 14733 - protein, 134 aa, Actinoplanes utahensis
MAPSSTSWRFARATAPAVRVLAGRRLIPLWAVVHHRGRVSGRALTVPIALTVAPDVFVINLPWGATTNWVRNVLAAGGCVIRWKGADHPVRDPQVIGEVQARPYYGRVAWAIARRLFPADEWLVVSRHTANPAR

SEQ ID NO: 14734 - protein, 135 aa, Actinoplanes utahensis
MPWIRRRRYDYYDPYYDRRYRNPQGSCLRDACLLETGCCIAEGLDGNCLMLTLPLLPRLLTATTTGGGGLLGGIRFYQREISAHRPAVCRFTPSCSEYAAQAIERRGALRGALLAARRLLRCRPGGARGSDPVPA

SEQ ID NO: 14735 - protein, 67 aa, Actinoplanes utahensis
MTTGTVKWFNADKGFGFISPDDGGADVFAHYSAISAGGYRSLDENQKVEFEITQGQKGPQAQNIRPL

SEQ ID NO: 14736 - protein, 106 aa, Actinoplanes utahensis
MRVRPTEELKDNTMTTNYSGPAKLTLVDGACISGMVSLSTNQRGGITGWGGTFRPDQITTELRNAGDGLQLELPYDRVGTVAVTGMRKLLATQLLMSLTGQGPAPF

SEQ ID NO: 14737 - protein, 241 aa, Actinoplanes utahensis
MLSVQVSGRDDGPVLLLLAGQANSHLWWTGLREGFEDRHRVVTFDWRGTGDSRGPVGDWTTRSFADDAASVLRSLPGPADVYGTSMGGRVAQHLAAGYPGLVRRLVLACTSPGGPQAHERTPEVRRRLLEARAGTLRELFYTDGWDGHSHLFGDPTMSAEESRAHLRASNRHDAWDALPRVRAPTLILHGTDDRMVPSANAPLLAARIPGAVLHLHEGGRHGFFDEFAGEITPIIDDFLGD

SEQ ID NO: 14738 - protein, 412 aa, Actinoplanes utahensis
MNGDSGGTWTSPDGSYMERLLCHRRLPLIAGVNGSRPAVHVWEHGSGGLRQLGVVDAGGEPYPAEAWKRQALVPEPAWHPSAARLVVTGPAGPHLWTPEGTAPLPASRPGHAYRFVAFSPDGRTLWASPSALFDPESAGERSDAIDLATGELRPGPRWDTAVVEHPGGGLLATMVSDQGATHILFARPGADPPAGLTLLRDAIILDVDGYETPVFSDDGRFLAVRGNAYVQSLDVFTFPAMRRVLSTTLGEPYPGYPYPPEWLAEQQRWSAHNIAFAPGTGTLLVGTARGGILGIDLDTEQVAEEEHSSAPISALAITSTGRLVVADRAGQVTVTQHRGRRTGDSRPARAVAARFRAATVELPEGADLAEHLIRHDGERVWVPGDLGDVTAAAETDPTWLRLQAAINTAQRR

SEQ ID NO: 14739 - protein, 242 aa, Actinoplanes utahensis
MLLYDMIGADYPTTRSTDPRIAARIRTALGDARTVLNVGAGTGSYEPPDLAVTAVEPAAVMRSLRPPGSAPCVAATADRLPFADRSFDAAMAVSTVHHWPDPVAGLRELQRVARRVVVLTYDAACSQHFWLNRDYLPEFDGLLTAWPSLAELTGALGARAEPVPIPWDCTDGLFEAYWRRPEAYLDDRVRRAVSVWTRVGPRAERRAVTALRADLASGGWAARNRDLLALDSADLGLRLLVA

SEQ ID NO: 14740 - protein, 654 aa, Actinoplanes utahensis
MLSVLLFVPFLILTVLAFAAIIRRLLGVRVGLGRTLLAAVLATGVTSPLLAALAPPDPRHVTTGQGVLLMLAAASVAVLIAMAALVIAEVLLPTGTLPGPVELWRGTRRRIVRTRRYAAIVRIALRHGLGRFLRGRRQTGPTSAAARRRLARSLRAALDEGGVTFVKVGQLLSTRRDLLPAEFVEELTALQDRAAPVPWERIEAVLSAELGRSAGEVFATIDREPLAAASVAQVHAATLPDGTPVVVKVQRPGIATIVDRDLDILRRLAATLEARTSWGRSLGVRGLALGFAEALREELDFTVERDNLQTMAAALATAPERGVRVPTPYAAISSEKVLVMRRLPGTPLGSAAPVLDRLGADRRETVAAALLDSLLDQVLVHGVFHADLHPGNLLVDHDGALGMLDLGSVGRLDAITRAAVGRLLGAVGRGDAVAASDALLDLADHTEEVDERDLQRALGVLLVRYAAPGSSAGVAAVSALVRTLTAYGLGIPAAVAAVFRAFATLEGTLGLLRPGFDLIAQARASAGRRLAATFAPANLSRTVEEELIALLPMLRGVPRRLDRIGDAIENGRLRLNIRLFSDDRDRQVVTGLVHQTLLTVIGAAAGVMATLLLGTTGGPRVTTGIGLFPVLGYLLLIVAVVLVLRVLVVVLRRD

SEQ ID NO: 14741 - protein, 232 aa, Actinoplanes utahensis
MARLLLIRHGQASFGADDYDALSDRGHEQAAALGRVLAARGVRPTLLLRGTMRRHRETLDGLGLDAPVVTDANWNEFDFQHVVEVHRPHFRDRAAMMAELNRSEQPGRAFQAIFDEATARWCSGAFDAEYAESFAAFRTRVAAALTAVAALLREHRDVVAVSSGGPIAIAAALLTAGPDAPANTLATIWAALNRVSVNTGVTKIIAGRAGLSLSTFNEHTHTETEPRLLSYR

SEQ ID NO: 14742 - protein, 251 aa, Actinoplanes utahensis
MPYRVGMSRGVVLITGASAGLGEEMARQFAALGYDLALCARRVDRLAALRDELPGRRVVVKQLDVTDDAAVSRVFGEFAAEFGRIDRVVVNAGLGKGAPLGTGRFAANRATAMVNFVGALAQADAALEIFRRQRGGHLVLISSMSALRGMRRSMTTYAATKAGVAAIAEGVRSERIPGVDVSVIYPGYIRSEMNEHVQQKTRFMVDTPVGVRAMVAAIEKRRLKAFVPAWPWVPIGAAMRLLPLSVVRRMV

SEQ ID NO: 14743 - protein, 68 aa, Actinoplanes utahensis
MTCRHGRARRRTRRNRVLIHPINVGSQDVAAAKGDTFTSIAHLDLGGNRHYGMVMTGGETSGPVQAAE

SEQ ID NO: 14744 - protein, 154 aa, Actinoplanes utahensis
MVWRKFWRTVGSIPGFTPIAKRTVTLDRWVSRITRGRIVALGMAPGLLLTTTGRRSGQPRSCPLQYVTDGEGYVVVGSNWGGPNAPAWVHNLRATPRATITIGGRDVPVDALEADGDERERLWQLFVDQWPGYARYRDRAAHRTLRIFRLVPVR

SEQ ID NO: 14745 - protein, 211 aa, Actinoplanes utahensis
MGQPGHPGRLRSAAQPDGSVDATDRKAHPRPAPGRRQRPDVGRGDPHPRRRPGVMTVEISYRPADAPVPRLAALFATAWWAAGRTDDEVARIVAGSDVVVAAVDRDSGRLAGFARVLTDGVALAMVLDVIVAPEHRGTGVGALVMDAVLRHPAVAAARSVELVCQPELLPFYRRWGFTDRVGRSRLMRRTADPALTDDDQTPPTAERRPVP

SEQ ID NO: 14746 - protein, 396 aa, Actinoplanes utahensis
MGVNPHEQSPYTPMPPQQYWPQPAPPPRRRPVGALVAGALAALMVTGGAGFAAGWGLRSEPVAQQSTRGSHLPRDPGDGASSSAGATDAQVAAVAAKVDPALVDIDTVLGAQNGAAAGTGIVIGADGIVLTNNHVIAGATAITVTDIGDHRAYRAAVVGYDRARDIAVLHLDGASGLATATLAESTPVRQGDPVVAIGNAGGAGGTPGAVGGVVAALHRSITAQDASSGASEQLTDLIEVNAAIRPGDSGGPLLTTDGTVIGVDTAASTGFRYPASGGAGYAIPIDAAMSIVRQIQAGQASDGSHLGATGYLGIGAADGAGGAAVRSVVRGSPAASAGLARGDTITAVDGARVGSAAALIERLDRHHPGDRVKLSWTDTAGRTRSGTVALASGPVG

SEQ ID NO: 14747 - protein, 142 aa, Actinoplanes utahensis
MGRTRKSLLIVGPLAAGVVVAATAVRRRGAAPPTRRRHVLTVYKPLSELESTQLPGSLREIADRVEISLAAAPGGRGTEIAVRIPDGSPVTDGDVRRALRETRSLIEAGDVLLPSGPATTTPTLLNRPLQAATRNGREGGLL

SEQ ID NO: 14748 - protein, 389 aa, Actinoplanes utahensis
MKALQWEGVNKLAVGTVPDPELRNPGDIIVKVAKTVTCGSDLHLLGGYIPFMQKGDVLGHEFLGEVVEIGPDVRNHRVGDRVVVSSFIACGNCWYCDQKLYSLCDNGNTNPAITETLWGHAPSGCFGYSHAMGGNAGSHAEYIRVPFADVGAFTVPEAVSDERALFASDTAATGWMGADLAGVAPGDVVAVWGAGAVGQMAARAAVLLGADRVVVIDRLENRLRQVRQHIGAETLNYEQTDIAGELRELSGGRGPDVCIEAVGMEAHAPGPHFAYDQLKQQLRLQTDRPIAVREAIHACRKGGSVFVLGVYAGFVDKFPLGALMNKGLTVRGAQMHGQRYIPMLLDRMATGELTTEHLATHVMPLDRAPEGYQIFKDKKDDCVRAVFVP

SEQ ID NO: 14749 - protein, 246 aa, Actinoplanes utahensis
MHSLHFTAQTTADGVLERDFLVGDIPGVLWSPAGDAGPGPLILMGHGGGLHKKTPAQAARARDLVTAHGFRVAAIDAPGHGDRPRGPEDDRARAAFASGDPSLFRSASVRYGIHLAAQAVPEWQQTLDALQQLPEIGPDAPIGYGGGITLGTAIGLQLTAADPRIRAAVFGSGFFVYDAARQAARRITVPVQFLMPWDDEHVTRAEALELFDAFASPEKTLHANPGDHRRIRWYGLDHDFLPRHLK

SEQ ID NO: 14750 - protein, 210 aa, Actinoplanes utahensis
MTSPRPRRSPPPQERRRDPERTRRKILEAAAVEFADHGYAGARTRAIAARAGVNQQLVSYYFGGKEGLYRAMSDQWRQRRDDLAPDGTPMPEQLRRYAMEIVHNPDGVRMFAWSGLQYTGPDDDPDRDSRTQMLGGSVTHLRRLQEAGRLPAEIDPVCLQIMLMAASMATTTLPHVIEGLCGADPRSPEFVEHYADQVALVARLLGLDED

SEQ ID NO: 14751 - protein, 367 aa, Actinoplanes utahensis
MIDKDMRALDTVSGMTKILISGAGLGGLALAQALHRGGFEVAVHERDPGPQTRGQGYRLHIDADGNAALRDCLPPAVLDLVRDTSGVTGDLVATLTPDLRRVFAQEFPGIPDTEITNVDRETFRRGLLTGVTDLVHFGHTVADYRVTEAGRVRVTFAEGGTDEGDLLVGADGAGSAVRARLLPGAAPRDLGLRCRYGRMPIDATTGPLIPADFRRGFCWVTGSGGWGAGFAPVVYRDGRPGYLMIALVGPAGTGQPDDWHPKIQQLLSYADGSSFFPITIRASVRTDPWAPGPVTLLGDAVHTMPPAGGVGANTALQDAATLAAELLSGRPLPDAVAAYERVMIPRGYDTVERSVQMITQMSGATHS

SEQ ID NO: 14752 - protein, 131 aa, Actinoplanes utahensis
MPHVTIHALEHELASHEPALIAKLTTAVVSVYGERVRSSVDVKLVGIPAGRWARGGAAVATAAPSVTFGMREEVFARPDAATVAAHLVAALAEAITAVFGDGCRGDVLVEPVGRPTSRSGLGGRVIDVVSD

SEQ ID NO: 14753 - protein, 219 aa, Actinoplanes utahensis
MDLPNDAAAIIFDCDGLLVDSETCWTRAETTLFAEHGHGFGPEQKNLLIGKTLPAAGEVMADHFGLPGSGPALAARLSALVAQELATGAEPLPGARNLVESLLGRVPIAVASNSPRAFVDAALITSGLADLFKYVYAVGDVEHGKPAPDLYLAACAGLGADPARCVAFEDSATGVASASAAGLFVIGVPSVPGTTLKAHRSYASLTDPGLLAWADRLAS

SEQ ID NO: 14754 - protein, 254 aa, Actinoplanes utahensis
MIVEYLRYRVDADRAAGFEQAYQRAAVQLAAAPQCVDYELSRCVDEPAAYLLRITWTSAEDHLKGFRGGELFPGFLAEIRPYVDDIEEMRHYEVTGVHGTGGSVPTMYEWAGGAAAFERLTAAFYTRVLADDTIGPLFAHMDPSHPRYVAMWLSEVFGGPSAYTDSRGGYAHMLGKHLGRAITEQQRRRWVALLVDAADEVGLPDDPEFRAAFMGYIEWGTRLALANSQPGAAPPRQAPVPHWGWGVAPPYRVP

SEQ ID NO: 14755 - protein, 902 aa, Actinoplanes utahensis
MQVQRRRQVRQRSGRWFAVTAGTTATVVLAGAGVAYGSTLPFGHDQVGQVTAKGQVVSADQYIDPIGKRLVIDKGKIMSAVVSPDGTHVAASITDGGMALAVVDLTTWRVQQLIGNNAAADLKISGNDVGQEGPTYSPDGRQLWLAQATGYRRFTVHDDGTLADPAFVPIPTDATKKALAGQAVFSADGATVYAAVNGQNRVVAIDAATGAITRSWATGNAPRDLALVGSKLYVSNEGGRTAVTGDTTLNSYDTQVPANPVTGATTTGTVSVINVADPDAAVGSITVGLHPTAVYAHGSTLFVTNTATNDVSVIDTARDAVVQTIATQPWPEASVGYEPDAVTLTGDGHLLVTLGRANAVAVYRFRGAQEPVSYVGLLPTDYFPAEIATVGGQVLVANTRGIDARRPTTAAGHGSHDTTSSLQRFALPADRVIKAYTAKVFRQNGWTPGSVVEAPKRGRVRATPVPARLGDPSTIKHVFLIVKENRTYDQMFGDEPRADGDPAVAEFGETVTPNQHALERQFGLYDNTYDIGTNSAEGHNWLMQADDPEYTESSAGEYTRSYDTEDDALGHQRTGFIWTGAQAAGRTVRDFGEFHQFLTKPADATWQNLYCDAKTMSAAGADTAYHLVSSSPIPSLNSVSVPGFPKFDTAVPDIYRYEIWKRDFEHNGPANLNMFWLSSDHTGGPPSAAAQVADNDLAVGKMVDTISHSKYWKDSAIFVVEDDSQAGLDHVDGHRAPIQVISPYARHGVVDSRYYSQITMIRTIEQILGVHPMNQKDSAATPMVTAFTGRPDFTPFTALPNRTSLTLGLSTPPPCGADTPVAAAPAAAVPAAVTPLVAQWEAWKSRQRLTGPDAVPDFANPAQMNHFTWYQTHNWTKPYPGEATIVAPDRVPGAYLPSTDTD

SEQ ID NO: 14756 - protein, 453 aa, Actinoplanes utahensis
MTAGIAPDPQRTGERPVPVPVRRGYRFELVKLGAQWRIRLLVLACWIAPGLFVAGVGQQTTLPVDTLFGRWMLATGWASPLVMLGFAGTWGLPLLAAPAAGDVFAVEDRLGTWRHLLVTVRSPRRIFVAKTLAGLTVIVLLVAGLAVSSTVGGLLAVGDHPLIGLDGQVLTAGSAGVPAILSWISALAPTLALAAIGLLGSVALGRNPMGLLLPAMVGLGMQVAQMLPLPVAVRLALPIHAFLSWHGLFTSPRELGPLLISVAVSLLWAAAATALAYRIFVRRDFTPAAYDGSGRRALVDGALPLAGLAVATVGLLLVTVPGSTGTGITQARVESSVATTFARLYRLQAGQLHRPDVTEAQLQAAAACTKGGGLVDAEGPGNDWRCVVSWHLPEVTAVGQAVYQLDVATDGRYVADGDGPKEVNGYFVVRTDNGDAPNPLWQFDGIVELLPKG

SEQ ID NO: 14757 - protein, 315 aa, Actinoplanes utahensis
MPALHAIRARGVTKRFGEVVALDGVDLDLGRGQIHGLVGPNGAGKTTLLGLLLGLAVPDGGTLEILGVPVRRALAGPDGVAGFVDGPGLYPSLTARQNLEALAALRGQVSGGRTGRVRAGAVAREADLDEVLGQVGLAEVADDRAGTFSLGMRQRLGLAAALVTRPRLLVLDEPSNGLDPAGKRQVHGVLQRMAADGTGVILSSHRMDEVEAFCSEVTILNLGRVVFSGPLAKLAAEHRELEYRLVTSDPAGARRVAGDTPGVAVTGDLVIRALLPALDDLVVRLVRAGIAVRELTPAVSPLEAAFLSLTEAAAA

SEQ ID NO: 14758 - protein, 500 aa, Actinoplanes utahensis
MTDVVVAGAGPVGLLLACELRLAGVTVVVLERNTEIDLTVKAGYITVPGIQALDRRGLSPAIERARDETLARMGFAGRGPVQQKMPRFIGHFGGMMLDGQLLDPDDPDIAAGGRFSALGMVSQQQLEVILEERARALGAEVRRGVTLTDFEQHADGVVVTTDQGLIEAGWLAGCDGGRSTVRKLAGFAFPGTDPEITAYQAIADMIGTEGLRPGWHITDTGVYTFGPFPGRILVAEFDGAPADRTSPVTVDELQGAIRRVTGVDVTVTGISSVTRFTDNARQAGTYRSGRVLLAGDAAHVHSPFGGQGINLGLGDAMNLGWKLAATIRGWAPDGLLDTYTAERHPIGAQILDWTRAQIAIMRPDQHSRAIRGVLQGLTSTVDATTWLAKRISGVWQGYDLPGDHPLTGRSAPDLTFDDGTRLPDHLHSGRALLVDLADDPDLPALATGYADRLTVHSAKAATSDLTAALIRPDGYVAWASSGSPTTDLRHHLTTWLGNPA

SEQ ID NO: 14759 - protein, 206 aa, Actinoplanes utahensis
MGLRERKKRQTRELISGVATEMFVQRGFDLVTVAEVAAAAGVSEKTVFNYFPRKEDLFLDRLPELLALTTEAVRNRPEGTSVLAAFRGVVFDLLAAGHPLSAYPGRGHAGFYRVVVGSPALQARVREFQQELEDLLVELARESSGRGGGEGELRLRLAAAVTVAAYRTVYFRAAARVLAGEDPVAVGETLFAEYAETFAAAEKALS

SEQ ID NO: 14760 - protein, 483 aa, Actinoplanes utahensis
MRRPEETCVEQAGREETRLRIARYLDSPAPSAPPLTASASTGTASASGDAPSPPAGAPPTSSAAGPTSAADTSTSSATAATSAATGARLPATTATSAATGSTLPATTATSTATGSTLPATTATSTATGSTLPATTATSTATRSTLPATASTATASFDRRLPNIADYWPDAPGRRKAGWQGLLPGAGRRQGPLPGGGGDHSAGSRHPDRRPATGRGSDIPDSSPSSRRRRRRPVILAGVLALLVIIGSVLLARPLTNSDIHQRAAPVVPPLPSQVVIPLEPRPTPSSVAPSHAPSIPVIPVRTTAAARFELVTGVTDLSVRTARLDGDFKVSGPADSAFDDGVLRLSGNGDGSGPVEVQLSDQRVWRLRIGAGTKSVTLNLGAGTISRIDLNGGAERIDITLGRLAATLPIRMAGGVSTWQIRTAGEIPVKVTVGQGAGDIAFYGNHQGGIGAGATLRSGDFTAGPALDITATAGLGTLDIARA

SEQ ID NO: 14761 - protein, 272 aa, Actinoplanes utahensis
MSDRRSALDRIDTTVAHPARRYNYLLGGKDNFAADRASAEAIEKAMPAIRLAALENRAFLQRAVKFLAERGIRQFLDIGTGIPTADNTHEVAQRIDPAARIVYVDNDPIVLTHARALLTSTPEGVTAYIDADLRDPRTILDDPEVRATLDWDRPIAVMMVAVLHFIRDDEDPQGVVDTILDALPPGSYVVASHSTWEYLPADAIAALEAANADGRFRARTGEQLGKLFQRLDLLEPGVQSVSEWWPQEASQPRPSIEDVAFNAIVGQVRARG

SEQ ID NO: 14762 - protein, 492 aa, Actinoplanes utahensis
MGDEAAEYYDRMLVDAEWGEAFCLTMVRGLAEADLITAFGGDPAAVLPQAELAQILDTFPHGAEPATLVVTSLGGWRFGIEVNGGQGNRPEVLRRAAEAGDGTALSVFRDVRGRSEFTLVRDGRTMVVLDQVRPQRRSGEEPGLLDEHVGRLPFGHQDDIIPEAAGLALAERLTGVRLPPDLLDRDLPGVVLTPVPDDLVPEGGRGLAALDHPFLRRMLAEPTAANVPAMAAFRARLIAEDAGLIGEPAVRETLKALEAGREPAPELRARLRDLHERDDPQVMNAVRDIAAAAFPADGDRFGTAYAIRDSDRSLQATVLRRCAQRALRDAPPRPVMPAPSPAVSSAYAAVAKQFATWDPDKQRRVTRWLARRAFEVAGLDTLDWARPALEALDRGAPLPFPDRRAVFRLISAAALVTAATGLPLDRLEDRLTEEQRADLRERIDRAPMAVITIFNTADPDPARALADTFATALDTFHGRTGELLVEMHARFA

SEQ ID NO: 14763 - protein, 248 aa, Actinoplanes utahensis
MGPRTAPDAFRYGRRFHSGTIAAAHPGRPHRIGPYSGPPIGGFSVLLLVNRQDPRRCDSLFPVTVRRVTLAEILSFYRPAVGGDTWEQAIPDLLADPDDARIVDLLRSELVAHGDFAEPIVVDQQDRDILNGMHRIAAAVLNRQSALDVADTYADLPEKRRVLVVLGAEALSAAVVDRLTKVLWSFPFAGGWTNCDVMFPGDGRVSGWWHCPDGRDRALGDELVIRAAEAGIRLTVESITEVTGADPG

SEQ ID NO: 14764 - protein, 403 aa, Actinoplanes utahensis
MTPRPSADPAIGDRIRDRRLRRGWSIRFAASRAGVSHATWSRIERGRQAADNRFMLADLAAALDCSPAELAGTAVPAGDREAVAAHAAVHAVRQALVDLDLTATPASLPALPSLPELTRTAALLDTLRQACDYAGAGRLLPGLLRGLHAATGSEQRPAALRLLCEVTFIASSVLRNLGHPAEAWLGAERCRDAAEAARDPILRGYAGYSRAAAAGACGSYDRAYTLAAQAVDELRPHAARAGWPEMTGSLQLICADSSRGRKRSDDSRAWLTEAAALAARTGETTTLGLYFGPTNVNVWRVGIESDGDEPGRAVAIARETDPAVLPVGFRQVFFYADTARALTRLRHRDREAIRFLLTAERVAPQHVHTSSLVQETARALLDRSRRAAGGTELRALCERLRIG

SEQ ID NO: 14765 - protein, 829 aa, Actinoplanes utahensis
MTLTDRLPGTAEPDAVFEAFQSWVTEQGLTLYPHQEEALIEIATGSNVILNTPTGSGKSLVAAGAHFAALADGRTTFYTAPIKALVSEKFFALCTIFGAHNVGMLTGDASVNADAPIICCTAEVLANLALREGAQADVGQVVMDEFHFYAEPDRGWAWQVPLIELPQAQFLLMSATLGDTTRFVDDLTRRTGRETATVSNAERPVPLLFEYAMSPLHETIEELLTTKQAPVYIVHFTQAAALERAQSLMSINMCTRDEKDAIAKAIGNFRFAAGFGRTLSRLIRHGIGVHHAGMLPKYRRLVETLAQAGLLKVICGTDTLGVGINVPIRTVLFTGLSKYDGVKTRLLKAREFHQIAGRAGRAGYDTIGTVIVQAPEHVIDNERALAKAGDDPKKRRKVVRKKPPEGQIGWGRPTFDRLVEADPEPLTSSFQVSHAMLLNVVARGGDPYQAMRHLLTDNHEEPAAQRRHIRRAIAIARALIAGGVLERTDEGVYKLVDDLQLDFALNQALSPFALACLELLDREAPEYPLDVVSVIEATLEDPRQVVSAQRQKARGEAVNAMKAEGIEYEERMALLEDVTWPQPLLELLEGAYETYRRGHPWVGDYEIKPKSVVRDMYERAMTFTEYISFYGLSRSEGLVLRYLADAYRALRQTVPEDARTEELGDLIEWLGELVRQVDSSLLDEWERLRNPGAVIEEVRIDDKPPAVTRNVRAFKVLVRNALFRRVELAALGRYAELGELDGETSGWTTDRWRDAIESYFDEYDELGIGSSARGPQFLQIETSPAMWSVRQVFEDPAGDRDWGIDATIDLAESDEIGGAAIRIVAVGPH

SEQ ID NO: 14766 - protein, 183 aa, Actinoplanes utahensis
MPAPISDGDRERTAELLQHACGDGRLTLEEFSVRVGAVWAAETDAELARTIDGLPAQPVVGSAATVDKVVTIFSQTRRRGRWRLRDRILRTTTLFGSTELDLRSVLTGQDVIEISGTCWFGQMTVIVPEGMEVDLTGTHAFSQHELRLAPVRRLPGTPEVRVAVNAWFSQVNVESRPPELPTR

SEQ ID NO: 14767 - protein, 104 aa, Actinoplanes utahensis
MAVLADADHPLTPGEVRDVLDPAGDVSYSTVVTTLTRLFEKGSAVRQRDGRAFRYGAPHGPAGLVADRMSRLLAIEPDRASVLRRFVGNLDADDERLLRDLLNE

SEQ ID NO: 14768 - protein, 128 aa, Actinoplanes utahensis
MEDDAMDGCTVTVCRDCCCGSAGKHPTVDHDAQLDRLAAALGPAHRVRRSLCLDVCAQSNVLVVQPTPAARRDGARPVWFGLVLDDVVLDDICGWVRAGGPGRADLSPMLELSVINAPRAAPGLPAGR

SEQ ID NO: 14769 - protein, 47 aa, Actinoplanes utahensis
MAHLLRPQPVAAPRAAVLLPVLVALSSVLWTGEATLDLVELLHSALR

SEQ ID NO: 14770 - protein, 425 aa, Actinoplanes utahensis
MERRRVLGLAGAGAAGVAVAGAGAVALTHRDSAATPASGAGSAADAAGAIPFYGARQAGIVTPAQDRLHFCAFDVITNDKAALIDMLQDWTAAAARMTQGRDAGTFGAVGGSLEAPPDDTGEALGLPAAGLTLTIGFGPTLFRDAQGRDRFGIAAKRPAALADLPKFPRDALEEAISGGDIGVQACAHDPQVAVHAIRNLARIGMGKVSVRWSQLGFGRTSSTSTTQATPRNLFGFKDGTRNLKAEEPAQLDEHLWVQPGDGPDWMTGGSYLVTRKIRMLVETWDRSSLTEQQTIIGRDKGEGAPLSGRQEHDEPDFKAQDGEGQPVIPVDSHLRLAHPDQNAGARILRRGYNFVDGSDGLGRLNAGLFFMAYQRDPRKQFVPIQNQLAKQDALNEYIRHTSSALFACPPGMPDAGDYWGRTLFT

SEQ ID NO: 14771 - protein, 378 aa, Actinoplanes utahensis
MNTARLLTAGAAAALLLTGCADKGADKAGSGAAGTGKITVAASDTECKVDRGTAGAGTVTFGVTNKGSKINEFYVYAAGDRIMGEIENIAPGLSRELIVELPAGSYETACKPGMVGKGIRNAFQVSGSAAPLTEDAKLAQATADYQRYVKSQTGALIEQTTAFVAAVKAGDVAKAKALYPVARTYWERIEPVAESFGDLDPKIDARDGDVEAGQEWTGFHKIEKDLWATKDITKDGPVADQLLKDVQTIVTKAESVTFSPVELANGAKGLLDEVATGKITGEEDRYSHTDLWDFAANIEGSQGAIQALRPALQDRDPALVKTLDDNFAKVQAALDKHRAGDGWKLHNQLTQADLKELSDDINALAEPISRVAALVAKK

SEQ ID NO: 14772 - protein, 281 aa, Actinoplanes utahensis
MTAIYLIGLREGLEITLVVSILVAFLVKSDRRPLLRPVWAGVALAAVISIGFAVLLQVGIAELSSTNQELFEGIASFVAVLFVTWMIFWMRRMARHIGADLRDRMEGAIQVGPLAVAGVAFLAVIREGLETSILFYAAAQGATDAKPLIGITLGMLTAIVLGWLLYFGAVKVNLGTFFKWTGALLVLVAAGIFKYGFHGLQEANVLGGLDKTAFDLTDSFPPTAWYAELLRGMINFTPAPTVIETVAWLAYGIPVLILFLWPARPQRPAAASPTTPATTAS

SEQ ID NO: 14773 - protein, 180 aa, Actinoplanes utahensis
MVNFIDPTDRAVWRPLWDLQAALDADIARLYAAADLGGLKSTWVKELIKLHAGGPMTITELAAAVGRTHSAMSQKVSAMRAAGWVRTTAGADGRTKKVALTAKAAAVADRLAAEWRATEEAVAEIEAEIPYGMLRVVRDIEAALSRKSFRDRIAERLAGDPAWGLAGDPACGLAGDPAWG

SEQ ID NO: 14774 - protein, 419 aa, Actinoplanes utahensis
MGPRRGSGLRPRRGSGVGLSAALIDLRPLRSSPAFRRLWAGGLLSGLGTQMTLVAVMYQVWRQTHSTVWTGAVALAQALPIVVFGLFAGALADRADRRRLSLGTTAGLTLCSALLTVQGFLGLLPVTGLLALVVVQACFVAAGGPAQRTFLPHLLTAEELPAGLALKHISFQAAMLAGPALGGLMLGWLGVGGCYLVDTLTFLAALYGIAGLPSLPGGAEPGRSGLRAVGEGLRFMAHNRAVRGALLTDLAATVLAMPISLFPLINAERFGGGERTFGLFLTSVAVGGVIASLLSGTYTRLGRPGLTMLGGAILWGLALAAFGLVTDPWLSLGCLALAGLADTVSVVSRATVIQQHTPAALLGRAAAAEQIVGQAGPDVGNMRAGLVAGAFSGPVALVSGGLLCVLAVGVIARTSSPRA

SEQ ID NO: 14775 - protein, 155 aa, Actinoplanes utahensis
MRKWIFALPALALVAGGCGSAQATQPDKVTGLHDKWVSCEQARKDEAGAPSGARLNDAFKPVAAVVCQIRPVPRADGSSAPVEQRVTDISELVTALRLPDDTASRSPVCTKIFIAPPWIALLDDQNRWIHPSIPVDQCHKPRTEVLTAVGKSRPR

SEQ ID NO: 14776 - protein, 213 aa, Actinoplanes utahensis
MNVDDFYRDVARIALAVADKHGFVLGGGVAWLVNGLVARPTEDIDLFTDTAGGVTAAAGEVTSALTGAGYRVVREEGDELFPGMDADIQEFLVAGEHRALRLTLCRLDRRRTPVVMDLGPVMHLDDLVATKVAALVNRREVRDYIDVAAALERYPLDRILELAYAADPALDPEDIADAGRYLDRLDDARFTLYGLDPAQISDLRDRLSAWPRD

SEQ ID NO: 14777 - protein, 113 aa, Actinoplanes utahensis
MSASAAPVVHLARPHRPVVVAGTLAELRGPTCGFVELPLRLWWHPQRAFDLSQRTMLLWMYENVLRESIRVDELRAFLDGATLVRVWSELNLPRGVRAAWEARHPRLRLRAAA

SEQ ID NO: 14778 - protein, 285 aa, Actinoplanes utahensis
MMGMRMPYESTGRTRQKSRTRQALVEATRELLADGLTPRVEDAAAHSGISRTTAYRYFANQHSLLLAAQPQIQPDTLLDATAPTEPRARMTAFMDAFTAYNLQWEPQLRSALRLSLAAPRDTAVPTPDRPELRFAAARAHTGRHDDTVWHAPPPAATRQGHPDSDPTSTQPDSSAPAGTDSSGSAGTEQPLLRRGRAIGWIEDALRPLADSHPAIDRRSLAVAIRSATGIESLIWLIDIAAQTRDQAAATVQGTALALLDAAMNQAPPQQASRADNGLHRQPTPG

SEQ ID NO: 14779 - protein, 113 aa, Actinoplanes utahensis
MSSHDPIQTDPDLYKVVFENERVRVLEYRDAPGDKTHTHRHPDSVMVTLSSFRRRVSSGDQAVDVELPAGAVRWVGAQEHQGHNVGDTPTHGIFIELKEKPAVQVPGLLGPQT

SEQ ID NO: 14780 - protein, 214 aa, Actinoplanes utahensis
MSMDYYLLAGDVLLVEEFTYGPDHVTVALSGAMWSAGSDGWSDAGSFGRLLRTNEQLLATATPITRDRAERIHLELSGGALPTEAALRGVFGEVVRFANAAPLRLSMDDTPDGFQEKRIYRVLFAKEPRAAQLAELSAAWRGTTGGGMPSGNGRAGDHLFTWNLRRVGQGIAWGLDVTVLLGAETADITGTVLRKLTADVRRQGLVPLTTERFA

SEQ ID NO: 14781 - protein, 222 aa, Actinoplanes utahensis
MGPDYLALLRNELTTFQSRLTGDLDAPVEHCGDWTLRDLAGHLAQGNLWAATAVTERHGRFQGPPAPDDIAPWVEESSRILLATLSADPDTEASTFWPPRTVAFWRRRRWLETLIHRWDAENALHLPSELDPAWCADGIAEVGDTFLPRQIALGRIPAPTAAVCFAATDLAESWTLGEGDPITTLSGPAADILLALWNRLPWSSLTGDHEAARKALPGPVTP

SEQ ID NO: 14782 - protein, 135 aa, Actinoplanes utahensis
MGGTLPRTDTGRVPLGRLHHVIVDCPEPRELAEFWSAVLGEPVTYDDGDFVVVSADTTTSGLAFQRAPDHRAPTWPDAAVPQQLHLDVMVEDVALAGAAVVALGAVALPGDHVFADPAGHPFCLIPRPGWAPPMQ

SEQ ID NO: 14783 - protein, 191 aa, Actinoplanes utahensis
MTQDGELDVLVRQRIRGLRIARGWTLDELASRAYLTPSTLSRIETGHRRIALDQLAPIARALGTTLDQLVESGRDEDVVIRPHHDDSRGMTTWLLNREGAPTGMTVAKLRIDRPVPQDLRVHPGRDWFVVLAGTITLRLADRTITVRAGEAAEFSTMVPHAFGSAGGPAEVLCILDQEGERSHLRPHHPHS

SEQ ID NO: 14784 - protein, 312 aa, Actinoplanes utahensis
MANEHGHGGQHGNGELRGDAQLRHGGHGHGGDGSGGHGHGGHGHGGHADGGDGSGLAQMLDLDAEVLGDYYRELMDWAASLVPGEPAIVDLGAGTGTGTIALARHLVGARVTAVDVDEEMLALLRQRVDAAGLRDRVRTVRADLDGDWPALGAADLVWASASMHHLADPQRTLEQVKDVLRPGGVFMITELDGFPRFLSDPAGVALEERCHAELARMRLEGGLHMGEDWGARLTAAGFAVEAERRFDIDLTPPLPPQAGRYAQVTLERTASRLADRLSGDDLAALRDYAASAPARSDLTVRATRDVWIGRRP

SEQ ID NO: 14785 - protein, 248 aa, Actinoplanes utahensis
MTIDVPSWAASAARELPYPLVFCTVSGAHLYGFASVDSDLDLRAAHVLPAAEVVGLHHGPETLQRGGVRDGVELDVVSHDLLKFAKLLNSRNGYVLEQLLSPLVVVTSPLHEALTALAPGLITRHHSYHYLGFSHSQEKLYAKTGELKPALYTLRVLLTGIHLMRTGRLETDLGVLGAEIAYVPDLIAAKREAEHGPFPPGVATRLAADIPRLRADLEAAKDASALPDRPAEATVTALHNLIVTTRLS

SEQ ID NO: 14786 - protein, 224 aa, Actinoplanes utahensis
MTDLVEKHTILGVVVGSRAYGLDGPGSDHDRRGVYAAPTRDFWRLDKPPTHLDGPVEEQFSWEVERFCTLALQANPTVLEVLWSPLVETVTADGEELLAARTAFLSRRVADTYGNYARDQLDRVAARRARTGETNHKQAMHMIRLLIAGAHVLRTGEVLVDVRPLRDRLLAVRHGELSWEAVTGWAADLLADLDRARSETRLPSDPDRDRVEHLLTGIRQRRLS

SEQ ID NO: 14787 - protein, 331 aa, Actinoplanes utahensis
MTYSPAENRYASMTYRRAGRSGLRLPAISLGLWHNFGDGRPADRQRDIVRRAFDLGVTHFDLANNYGPPPGSAETNFGRILAADFRHHRDEMIISSKAGYAMWDGPYGDFGSRKYLISSLDQSLRRLGVDYVDVFYHHRPDPETPLEETMSALDRIVRSGKALYVGLSNYKAEQTARAAAILRDLGTPLLIHQPSYSILNRWIEHDNLLDTLEEVGAGCIAFSPLQQGLLTDRYLNGIPDDSRIRTSVFLDEDALDAKTLGRLHALDDIAQRRGQSLAQLALAWALRDPRMTSLIIGASSVRQLEDNIAALTNPVLSEAELGEIDATVLDL

SEQ ID NO: 14788 - protein, 936 aa, Actinoplanes utahensis
MTSSFTHRHIGPQADEQAAMLKAVGYASLDELMDAAIPESIRFRGDLDLPSGASEEETIAELRSIAARNTVATPMIGLGYYGTHTPAVIKRNVLENPAWYTAYTPYQPEISQGRLEALLNFQTMVTDLTGLTTANASMLDEATAVAEAMTLARRSCRSKSPVYVVDADTLPQTLAVLRTRAEPLGIEVRLIDLDAGADLPDEFFGLHLQYPGASGAVRDHAALVEAAHAKGALVTVAADLLALTLLRAPGEIGADIAAGTTQRFGVPLGFGGPHAGYLAVRAGLERSLPGRLVGVSKDADGAPAYRLALQTREQHIRREKATSNICTAQVLLAVMASMYAVYHGPAGLRAIAQRTHGHALTLAGSLSAAGVEVAHRAFFDTVTAVVPGRAAAIVAAAAEQGVDLRLVDADRVSVATDETTTAAHVATVLAAFGVPVAEAAECGAKALARTGDYLHHPVFNTHHSETGMLRYLRKLSDRDYALDRGMIPLGSCTMKLNATTEMEAVTWPEFANIHPFAPASQTEGYEDLVAQLERWLAEITGYDAVSVQPNAGSQGELAGLLAIRGYHRSRGSLGRDVCLIPSSAHGTNAASAVMAGMRVVVVACDENGNVDLTDLAAKIEKHRDALAAIMVTYPSTHGVYETGIAELCERVHEAGGQVYVDGANLNALVGFAKPGRFGADVSHLNLHKTFCIPHGGGGPGVGPVAVRAHLAEFLPGNPLEQGDHHAVSAAAHGSAGILPISWAYVRMMGPDGLAQATATAVLAANYVASRLREHFPVLYAGENGLVAHECILDLRPITKATGVSVDDVAKRLIDYGFHAPTMSFPVAGTLMVEPTESEDLAELDRFCAALIAIKAEIDQVAAGTWPRDDNPLANAPHTASAVTADEWSHPYPRSVAGFPEGVDRTAKYWPPVRRIDGAYGDRNLVCSCPSPEAFES

SEQ ID NO: 14789 - protein, 66 aa, Actinoplanes utahensis
MCQHLNQCPPADAIDREAARTVATFCEQGWSLLCNGVIVFEDTGELLPDGTTIEPHRGPARHALAA

SEQ ID NO: 14790 - protein, 320 aa, Actinoplanes utahensis
MSADAGSVMINATPGGPSPIPVVPDVYAVVWVHASVAPPGSTGDWELGSWHESWTTDEHARAVQDVRDAIGRGDVYQVNVVGHAAAAYTGNPQAALRRVAALPGARYGGILADDRAGWAIATASPETLVEVRDGRVVTRPIKGTRPATAAGRRELLASAKERAEHIMIVDLERNDLARLPGTGPVRVDELFAVRRWCGLWQAESVVSAPLTGDVGLADLLRAVCPGGSVTGAPKIAALARIAALEPVGRGVSMGALGWIGHDHLDLGLSIRTVAVDGRRVHAWAGGGITADSDPEAEVAEAAAKAAPLRAALAGTVTATA

SEQ ID NO: 14791 - protein, 189 aa, Actinoplanes utahensis
MTHAFPRTRSTVTAEKATPMLDALDPPAAVEFTRFARDTRQRLHGSAFQLCRDWHLAQDLTQATLTKLFLSWERAADSDNLSAYAQKILFRTYVDHRRRRASTEAAIGELSEPAYSIDPDLRITVLAALGRLPARDRAIVLLRYFADHSVEQVAAELDVPITVVKSQTRRSLIKLKHMLVGDRQALLAA

SEQ ID NO: 14792 - protein, 207 aa, Actinoplanes utahensis
MAAVGHDLRGRLMPALNYPAGALLIVAGVPGAGKTTLLQRLLPHPGVRLLDSGQAREELRPYLGAVPYRYWRPVVHAAHYVRLYRALRQPGAIVVHESGTRRWATRLITAAARRAGRRTHLLLLDVDPAQARAGQVARNRKVRRSSFAGHCRNWQRLLRSVADPADRIHRDTATITIIDRPLAAGLTAIRFDGLHIVPAARALRRAA

SEQ ID NO: 14793 - protein, 79 aa, Actinoplanes utahensis
MHPARVPHLVLPPQQRRNFRAYAGYTTAPTGPHDTGTLVEVLLRAGLLLAVTGYHRRVAAGRAADKAGPRTKPGHGPPG

SEQ ID NO: 14794 - protein, 162 aa, Actinoplanes utahensis
MTIRPIRLYGDPVLRTPADPVTDFDASLREIVRDLEDTVREPGRAGVAGPQIGVGLRVFSYNVAGQVGHLINPVLSDFDGEQEDDEACLSLPGLGYSTKRAMSVTARGFDQHGEPLVIHGTGFLARALQHETDHLDGRLYIDTLTGDTRRQALRELRRVVPR

SEQ ID NO: 14795 - protein, 216 aa, Actinoplanes utahensis
MTVPDPTDTRRYAAQSLAAGDATGWFERLYRDARAGRAVVPWDVAAASVSLREFPLPPGDGRAALVVGCGPGRDAEHLAALGYAVTAFDISATAIDLARQRHPGSSVDYRVADLLDPPASWRRAFALVLESNNVQALPAQIRARAIGAVGGFVADGGTLLVLAAAATDDPAAGPPWPLSRAEIGAFAAPGLREVSVEELATPGSRLPARWRAVFTR

SEQ ID NO: 14796 - protein, 184 aa, Actinoplanes utahensis
MGSRRTRQSKRSGGRRRLDVSAYPVAVILRGRWSVAGAAVVVVMAGVVVYEVRKPRGDDLPDTVRDGLAVAARDAIEGAATGDRLACAVRVIGADPPTATAAAQVRTAYVWSLCETVGARVQSGSSMPAAVHLTVPPTVETPGDGVAYGPDLERIFPARLRDAVLDVDGAALEPQVRQRIRERS

SEQ ID NO: 14797 - protein, 143 aa, Actinoplanes utahensis
MGTWDVGPFDNDTAADWCGDLDEAAPGQREALIRDALNRVAEHGDEYLDSDEAVEAIAAAAIVASQLPGGTAITTPYAPDFLLEGGRIEVPDDIPAIAVRALDRIVGDDSEWRELWAEAEESYPQALASVQAIRDTLERAIRR

SEQ ID NO: 14798 - protein, 187 aa, Actinoplanes utahensis
MAANPATSQEDLIRLVGDPHPHVRWEVADNPGCDEHVQRAICASPDEDLRFKLVYRKDLAPDVVAALVADSSVNVRSELAFETADSVALAALGADSVAKVRAGAAMNTRTTAEQRRVLARDRSALVRSALVRAVTLEEKDLQRLARDRSVEVRWRMAAALITPRHIRDILRQDPDASVRSQAEDPSY

SEQ ID NO: 14799 - protein, 205 aa, Actinoplanes utahensis
MVTSKIGRIAIGMVSTPLLLFVAIPLVLALLDAVTSAGNQTGEMDRTIQWMFVIEVAPFLTEPIREFIDARAAELSVSADVLWSAWQFTALAILVAGFTGVLWARIARLGLCLSIGGMLWVTTTGLHRQATLSFTLAWLMLEVVLSIRPVERLRRSRAIELLRRFWRNLTRPQLASYEQQHLEIEVLPEHSLDARSGTPNGQPQR

SEQ ID NO: 14800 - protein, 172 aa, Actinoplanes utahensis
MESDLSSCPAIADQLVARRPTEGPYRDRHSPPTDRRRLRIVAESSSIRAVWRQLARGSRQCPAPSGTSWAEDHVALTAIMGIGREKDCSLAGRSGSRFLIQEWGYPEIGVYFADRPSAGHDMIAFDYRDCGPRGEPRVVHVDQEVDYRITVLAPDFVSFLQALRPESDYGYD

SEQ ID NO: 14801 - protein, 83 aa, Actinoplanes utahensis
MTVQVTPADVTDRDAAREMLPKLRKNNPEVTLMWADNAYTGLADRARNDLNLTFKVVNRPPNRVGFKVLPRLLWNLICQVVQQ

SEQ ID NO: 14802 - protein, 341 aa, Actinoplanes utahensis
MRWRAAAAWMMAIIVCVASAGCSHRSGPPQMSSAARAYLARALDLLQRNSIDAGAVDWPVLRAKAYEVAATAQTSTDTYEAIHRAVYLLHDAHTRFFTRTEANLAFDQATMSDGPPTGRILPGGYALLTVPAMSGNDQAVAAYMKGGVQAVHELDQDHPCGWVVDLRGNGGGNMWPMLTALAPLLIGPTLGYFVDASGKRSSWILRDGQLFVDGSPQLPQPDNYSLARPQPPVAILTDPLTASAAEATLIAFRGQANSRTFGQPTAGFPSANEAFALSDGAVLLITVANDADRTGHVYPNLVAIPPDQPVSHSKPGPSTPRGADPVIDAATQWLAGTPACR

SEQ ID NO: 14803 - protein, 150 aa, Actinoplanes utahensis
MDCLACATDARFDDPPPRERIAADPHWRVVHAFTSTLPGWLVLIPRRHVTAIADLTDDEAAALGTWQVRVSRALHAATRCAKTYVVQFAEQDGFGHVHFPIVPRMPDLPDDRRGPAVFRYLAKAPTQGLTEAERDELALTLRAHLDPAGS

SEQ ID NO: 14804 - protein, 435 aa, Actinoplanes utahensis
MTTETGARTSRPGRRRGLVETAWLALLLVILSLLFLARYNDPRKIVSGDSFWYMRQALMYTGLTKQEAHTEAARQICREINRSLVANGHRPECVEYTLAGISPRYIAIFDSRPGYPLFASPFVAVLGAWTGMMAATMVLALLAATLAYLAVWMASGLRLAGVLSAVAMFLLPTGFLMTRMLTEGGVMAGYLASIIGGMLVLRGRRSGFAIIAASLVWLFAFRSASGMAMALALLAAGALAALRREHRRTSLILVATGAVAVLGWQLLSSLLHLPSLNDTIQDYATGHFTAKPDVPHPISWLIDRDLDFWPTQLKAELTVPTTLAAFGFAVAVLIIKMRPYAPLWIFTGLTGVMMVAAHPLKSQYDRLMLPLWLPVALAFGYAAALALRPATARLSGAGSADDPTGTRPAPVIPQARRPEPSPGEARPYNMAGDTW

SEQ ID NO: 14805 - protein, 124 aa, Actinoplanes utahensis
MPASFNHTIIASRDRSASARFFRDLLEIPEAPSWGPFANLQLTDGVLLQFAEPPVEIQMQHYAFLLDDELFDRAYSRLVEQEIVHWADPQMRRPGEINNEHGGRGVYFKDPSGHAIELITRPYL

SEQ ID NO: 14806 - protein, 73 aa, Actinoplanes utahensis
MTHRGRASEMLASLEGKLPGTATVIAAAHAHAVLAVADELHALRVTLQELSGSIVHREHRTGSAPRTDRRPGG

SEQ ID NO: 14807 - protein, 40 aa, Actinoplanes utahensis
MGRLSSRRAFGHNGSNACLGWADPDRGLVMAYGIGPACGE

SEQ ID NO: 14808 - protein, 249 aa, Actinoplanes utahensis
MNTYDLRDRTAVITGAASGMGAATAELLAVSGARVLLLSRRRDRLEDLAAKIIAGGGRAQALPVDVTDLDAVTAAAATAGEVDLIVNAAGVMLPNPIADGRADEWARMIDTNLTGALHVLRAFLPGLRAAAAAGRPADLVNVSSIGAHVTFPGYAVYAATKAALTHLSASLRTELGAEMVRVTNLEPGLTGTELGDHIDNPELAGQLGGMFELLPALRADDIADLIAYVVSRPRHVNLRQVIALPTPQA

SEQ ID NO: 14809 - protein, 277 aa, Actinoplanes utahensis
MNGEAEIGAFLRARRAAIKPQDVGLPALGRRRVPGLRREELAQLAGVSPDYYIRLEQGRGRNVSDAVLDAVARVLGLDETERRHLHRLARPAIAPVRRQRVRPGVRLLLDMMETVPAFILGRRMDVLAWNALGDAVNGFSSWPADRRNVARQAFLDPAARTFYPQWTEVAAETVAFLQLDAGRHPGDPLLAAMVDELSGASPEFARLWADRRVKEKASGTKVLRHPTVGEMALGYETLTLPGETDQMLVTYTAPIGSPAHDALRLLTSWNAPTRAVA

SEQ ID NO: 14810 - protein, 204 aa, Actinoplanes utahensis
MRFEPGQVIIRRYRRGPWRTWAQPMRVIRDDDAGLLLWAPEGGDFARLVDVDGRTTRDVSPDLMQDPRLARHTWRGNDVLILMPPGAGYSVWWFFVAGGFTGWYINLEKPAVRQEDGVETTDLVLDIVADPARNWEWKDTDEFAELTGHPLYFDSAEAAVIEAEAARLITLLEAGDFPFDGTFTGFRPDPAWDPPRLTDAAMHR

SEQ ID NO: 14811 - protein, 325 aa, Actinoplanes utahensis
MDFLHESGRDVSKGGHTCREAVSDPSLRMRAMRGEAGAAVLPLRVATAGESLDNAVALLRRRALPLLVMAAVLAAGEQVLLHRLRTGLYLRPPFYWPDMGYDPYYGYRGQPGAFGVWWQVVATGLATEVLIITLLGAYAGAAAGPALVGRSVTNRGVLRRTPPWSALLIAVVLAAAAWPLAYLGLVGLIVLYGLFGLAVPMLAFDGVNPVRAVVRSGQLSVRTGARVARVRILGYLTWLGIRAALGFGWIAVAGMLAVNVADAGWLDWVVPIAWGIANTVAYAALACLDAVLLVDARIRTEGLDIALHRARARGEDDAAVVAGAR

SEQ ID NO: 14812 - protein, 206 aa, Actinoplanes utahensis
MRGYDEFVGRIFDVVPGRVLLLILIIVAGLTAALWYWYPSWVPRRMPRMPRLPRFRLPRFPRWRLPRFRRRRRVRKKPDPVRPSPVPDDDPVADEPQPIGGLSLADRFALQGRYAEAIRERLRDTVRDLARAGVITPEPGATAAELAAAAAVRQPVVSAPLGGATEIFSEIWYGRREASPGHDARMRTLTDEVRAALTTVPGGPRP

SEQ ID NO: 14813 - protein, 300 aa, Actinoplanes utahensis
MTVKRRRLRVVIPLAVLFALVAGTLIVHAIEQPDQDDSDFLSPVSSAGIGADRLAGLLRGRGVGIVRETTSDEAIAALAGGDATLFVTTPAIADLARISLPDGRAGIRIVVVAPEQAQLTATPWPVRVRDSRWTTEVASPDCADPLATGAGRAGVHGLRYTSAAATSCYDGSLLDVPAGQAAVTVIGAADPFRNDRIGEHGNEALAVGLLARTSRVVWLDQHRRDTPPAPATTPTDEDTEDPYAAPPTRERETARPDRAPRRTPAGPGGGGDDDQARGGGEPDPLFQAFPPAVFATVLAS

SEQ ID NO: 14814 - protein, 847 aa, Actinoplanes utahensis
MPGSTSGPGPATSRWACCGPRPAGGSRRTWACRPGRCSPTWPSIPDTTRTTSARSSPTSTPTTTTSWSRPPPPCRTWYARSPDLKETSRDPRCPRSPPRPGPAARRGRQGRRRPGRGDRRRRGGAALRRPRAPRGRSRGGQDAAGAHPGRRPRPGHQAGAVHPRPDARRRHRLAGVRLADRRVQLPGRPGLHQPAARRRDQPDAAEDAGGPAGGDGGTPGQCGRHGPAAAPAVPGRRHPEPDRVRGHLPAARGPAGPLPAQARGAVAGTRRRAERAARPPPRLRPARPQGRRGERGGRRRRPGRRPGRGAAGAGRRPGARLRRRPVPGHPGGPGAGAGRVPARCDRAAGRVQGARLAERPRLRGARRCEGLHVADPATPDPAARRRRAGRGDRRVGAGRRPGLGAGAALMITRRFAGLLAAGLPLPALLPSPWLGLAVVLILAGGLALADLAVAGPLNGLRLRRDGDRTVWLGHPATTRLTVTNTSDRTVRVGLRDSWVPSAGAGPLRHSLELAPGGEGTVTTTLTPTRHGDRPAVRVTTRSYGPLGLAYRQRRRAFNDRQTPAWTLRVLPRFPSRRILPEKLARIRVLDGAVVTRGRGHGTEFDVLREYVIGDDVRSIDWRASARHHDVVVRTWRPERDRRVYCVLDTGRTSAVRIGDAPRLDNAIDAALLLSVLAARADDRVDLLALDTEIRVRVEGGGHRTQLPRLIDGMASLEPALAETDFTLLGRELLRRDRKRALVVIFTALDTAPMIEGLLPVLPRLAARHKVVVAGVRDPQVARLAALPATPTAADVHTAAAAERVLAERDRVRDVLGRSGATVVDADAADFASRVADVYLLLKASGRL

SEQ ID NO: 14815 - protein, 387 aa, Actinoplanes utahensis
MTACTRMSMPNAMAREPSRAGRRSRATASAVTRSVAAAVTRTASTTLPHNEPAGAAELMMDLDAYLAERGGEWRRLELLAGRAKDLNPGELDELVVLYQRAATHLSALRSRNADPVLLADLSRLVLAGRAAVTRTSGGFSLRPLADFFAYRLPGALFRTRAWWGTVGVVLVTVTAAMVWYLADHPDALAAFVSGDQIEDIAGRSFVSYYSEYRAQNFALQVWTNNALLTAQCLAAGVLILPVLYLLWGNLLNTGVLGAVMVSRNAGDTFLIYLAPHGLLEITCLFVGAGVGLRIGWAWIAPGPSRTRRQSLIDWFREGMVIAVGLVVALAVAGCLEAFVTPSGLPAVVRVGIGAVVWLGFLWYALLWGRRADARAPAGPDHADLPTA

SEQ ID NO: 14816 - protein, 151 aa, Actinoplanes utahensis
MTGVRLEPMTEEEYRSWRADAEAHYTRSVIASGRSPHDAARFAADTYQRLLPGGFATADNHLWYAHDGDRRVGFLWIKVEHGAAFVHNVAVEPDLRRQGHGRAIMQAVERWCRERGLTRIGLHVFAHNTGARALYEALGFVETGRNLAKDL

SEQ ID NO: 14817 - protein, 279 aa, Actinoplanes utahensis
MNHDLPGGRYRVGDLDLTRFGYGAMQLAGPGVFGPPKDRDAAIAVLRTAVDLGINHLDTADFYGPHVTNEIIREALAPYPDDLHIVTKVGARRDETGGWPHARSPRELRDQVHDNLRRLGLDTLDVVNLRVGGFDRPEPGSIAEMFGTLADLRREGLIRHLGLSTVSAEQVAEAQAIAPVVCVQNFYNLANREDDPLIDALAAQGIAYVPYFPLGGFSPLQTAELRRAADDLGATPMAVALAWLLRRSPNIMLIPGTSSVAHLRENLAGAALDLPAGLF

SEQ ID NO: 14818 - protein, 212 aa, Actinoplanes utahensis
MDFRQAAADGRQTAEALGALQAWLLAEDAYRRGGVPDEVLQFLQDHVGHLLGPQAMATAQIFLRGHADWATPARDRALLLDLLAEIEGARRPGFEFGWYAFGPDGADDGPTTLLVMAEYGVHDPVWERPRGSGSPVSLADHGVSESLVRRLRAWNETFERYGTRDEDRADDAWAAEGLALAHELQRELPDVEVRYYHGDDDRPLRDVVTGAS

SEQ ID NO: 14819 - protein, 280 aa, Actinoplanes utahensis
MTLPADSHVHSEWSWDTRVGSMEGTCERAVAIGLPALAFTEHVDHTSWPVPVDGPYASPELTAAADADGILHPPAFDAEGYLAAVERCRDRFPGLRILTGLEIGEPHWYAEQCARILSAGTFDRVLGSLHCLPDGAGFAEPWALFPHRDPAALVREYLAEIPRMVAGDDPFTVLAHIDYPLRSWPAEKSGPFDPALFEDDFRYALRATAESGRALEINTRIPMDATILRWWHEEGGRAVSFGSDAHRPELVANGFREATAMADAFGFRPGRTPWDLWPRA

SEQ ID NO: 14820 - protein, 331 aa, Actinoplanes utahensis
MNTAPSPWPRVLATVALLTVIISALLTAFAWPATRAAVHDIPIAVAGPPAAAARVTAAVADNRPGAFTVSTVAGTAAAETAIRHRDVYGAIDLTGGTPQVLTASAASPAVAQALQGVAAALSGSAAPPVRDIVPLPADDARGAGLAAAALPMVLGGMLAAVLLSLRVDGATRRIAGALTYAALGGLAMTAILQYWLGSLTGDYLTNAAVMALALGAPALTILGFESLLGTAGFGAGAVLLMLLGNPLSGATSAPEMLPGWSGAAGQFLPPGASQSLLRSAAFFDGHAAARPLTVLLCWLAAGLALTVAGSRRRSTAAAVTRVAPVPAAPHR

SEQ ID NO: 14821 - protein, 578 aa, Actinoplanes utahensis
MNHWSTHQLTEFFAAVCAPQEEHSAIMVAVERAAEVLETEIGAVLRDGRVEVAWGASREQLQSLLDGDPRPAMLTVPGIGELHVSTVRFGAKPGGTLLLARAGDPLDPEERQLLQAMAQTLGLALTNIGLLTTERSLREDREREASERLTLIESLREARHDPLTGLPTRMLFLEMLAERLAGSVPASVLFIDLDRFKAVNDSLGHRAGDELLGLVAGRVRGCLRPTDTAARIGGDEFAVLLADCPADQAVPVAQRLIDAIKKPFTVAGQDVFIGASIGIAAGPGPAPGELLGNADVAMYRAKTEGPGKVVLFEPQMHAEALARLTLNGDLQRALTLGEFRLQYQPLIDLDSGEPVGVEALVRWQNPERGYVSPADFVPMAEETGLISDLGRWVLHTAGRQAAAWRRTRPHLGINVNVSGRQLTDPQFAADVERMLSDTRLPAEAVTLELTESVLMSDPKTAIACLRDLQDLGVDVSIDDFGTGYSSLSYLQRLPVDELKIDRAFISKQIPTTADMAVIRTIVELARTLRLRTVIEGIETEAQRTAMRMLGCDLGQGYHLCRPVHPEDLLGSITPAEAA

SEQ ID NO: 14822 - protein, 442 aa, Actinoplanes utahensis
MPDHPGPEHRERVRVGRIERDVANEGAHRPTLGAHLNSGDRRPMSAGMTDGIGGERWFGSGHSTLSDPAAAGAEAAAGALGGRVPAVVFVFCSVGYQVPELFDALRAQAGPATVIVGCTTSGQLAEGRVSRAGVAMTAWGGAGFSVRTQVSESVSGRLRESGARAASALAGIDAEHRALLMIGDGLTGTQHEIVRGAFSVAGAAIPLVGGCAGDDLTYVRTYQFHGGRDGVAILSDAVVGVAVGSDRPLGVGIAHGWRKDGDALVVTSSRDGRVLELDGEPALDVFLRRLGVDESALDDPAGFRELAFHHPLGLSRRSGEDIRVIHDGNRTDRSLLCLADVPQGALVWLMESDSDALLDGAGEAAGQALDALGGVPALGMLVFDCAARWIKLGEAGVERENAEIGKRLDGVPYGGFYTNGEIARVRGALGMHHFTLVTLALA

SEQ ID NO: 14823 - protein, 155 aa, Actinoplanes utahensis
MKNVLPAALLTAATSLAAIPHPALAAAPSPIAAPSSAAARSSAAAPAVSATAQVYDEDSRLLAEARFDAPADAFTVTKRITGTERAYLEYRYTTPAGAVQTGTQWGSRAAGETLRFRHDFAKGRQVTFRVCLEGDHPFNPCSGADNGENWTLAIA

SEQ ID NO: 14824 - protein, 346 aa, Actinoplanes utahensis
MLVLTGADVEALCDLDALTAAMATALRELSCGRAHLPPRASLLVDGAGLLDMPSWIPALGALTTKVVSVFPGNAGGDVPVRQAMIVVFDPENGVPVAMIDAGWLTAARTAACSALSVRLLARPDAAVLAIAGTGVQARAHAVAVSRVRPFREVRVAGSSPDRAAALAEELSAVLPMRVRAVADHRTALRGADVVCGASFAVRPPIRREWLAPGTHVTSVGYRLDGREVDDATVAGAALFVESRDAALRAVPPTPDLAQPLAAGLITAGHVRAELGEVIAGTAPGRLDDAELTLYKSVGVAVQDGAAAALLLAAARDHGRGQEITGFSPIAGTSTAKSKASAAGSSM

SEQ ID NO: 14825 - protein, 426 aa, Actinoplanes utahensis
MLLSTLDPDAGLDDLEPLRELVGGARVVGIGESAHNVREYQQVRHRLVRFLVERMGFTDVALESGFSEGLAVGRWIAGAHSTAHDDHDAASDVHPDVAVEDRAGAADDVTDRGLTYGFGGTAETRRLIRWLREHHRTGRNVRFAGLDLPAQLGSLLPAIDGVARYLAEADPAAAQLVDRIRTYGKAWASPHTLVAFRAYQAVPPADRDALTILLSELATRMEAMRPLYARRGAGDGFATARHELRLAGLLDQMLRAQVAAVGGSGVHAAVNVRDAAMAATARHLLAGGGRLVISAANTHLQRIPISLGGTFEVPVAGGHLAGDLGDDYLSIAVTCGGGRTPTRRPAPGTESGVEVLTVDLAEPVPGSLEALLPHDGVRITDLRPLRGTPEAPRRFRNLDGYIELPAADAFDFAVLVPAIGENPVIS

SEQ ID NO: 14826 - protein, 382 aa, Actinoplanes utahensis
MAEPPPHITDALTARPTPVCAYLYDTTTLRRQAARLRAALPPRTTLLYAVKANGHPDVVRALLSACDGLEVASGGELTLARHAGARRIVFGGPAKTDAELTAAIDAGALINVESPFEARRLAALGFRGDICLRINRTTVAVTGSHTMTGSPTPFGIDENQLATVLRELPPQLTVIGFHLHAVSNNLDGAAHAAFLTQAIAWSMTTASRYGVDLRVVNAGGGLGIDYTSDTSIDLAPLSTVTVPDSLELILEPGRFLAADAGFYAAEVVDLKTTHGRTFAVLRGGTHHFRLPAAWGYSHPFTILPIESWTRPYPRPEVTDTEIDAVGELCTPRDVLTRGQHVAHLRVGDLLIFSRAGAYGWDISHHDFLRHPHPEFLIIDAEK

SEQ ID NO: 14827 - protein, 515 aa, Actinoplanes utahensis
MTSSLTTGRLAAAAAHTQAALAVHAPDLVTGFLDNLPRAADTVGRRLRGALAREGLTDDDAPGATRHAFHRIEFARSGVADPVDLLTGIDAPRFAAEIRNAVINLAVALARPGPAPGGDADEAAIAAERLAVTGHNLHPCGRTRLGWDTCDVLAHDLESGSTDIRFIAVRDDAHLGDDLSTHYPAIPRPPSGFRLQPVHAWQHDLVRHRYRDLFDAGVLRPADGHLDAVPTAALRTLLLPPAADGRRHYLKVSLDIQITSTRRSISVASTRNGPAVSALLHRLTTGEPTLLLMAETHGAAVPAGTGRDLSAIVRDGLTGRLHPGEEAIPGSALPHRLPGLLTRHGGGPAAWLRDYTRLLLPPLLRLAAHGVGIEAHLQNCLPTFLHGRPHRLALRDFAGLRLHLPRLAAAGHDVDLWPDSVVGTTDPAVMRAKLGYTAFQAHLGELVLHLDLDEPDAWRIIRDVVDETYDALDTPDARADHAALTAPTVPHKALVRMRLADNGDIYLPVENPLHG

SEQ ID NO: 14828 - protein, 590 aa, Actinoplanes utahensis
MARGWVPGERRHTGDAPIGENPIHSHIFNEREVIVDTDVIVVGAGLAGLVAAREVTAAGKRVLLLDQENAANLGGQAWWSFGGLFFVDSPEQRRARISDSLELAWSDWRGSAGFDRLGDEDSWAVRWARAYVEFAAGEKRSWLAGLGLRWLPFAGWAERGDLRAGGHGNSVPRFHVTWGTGTGVVEPFVAAAHRSAEAGLLGFRHRHRVDELIVEGGAVVGVRGKILAPDEGARGVASNREELQDFEVRAQAVIVTTGGIGANHDLVREYWPARLGTAPREMITGVPAYVDGRMLAIAEAAGVRLVNRDRMWHYTEGIRNWAPIWPGHGIRVLSAPSPMWFDALGRRLPQPYYPSYDTLGTLRYLRTTPELAEHDHSWFILTQKMIEKEWALSGCEQNPDVTAKDRRAFVRERLFGKGAPAPVEAFKEHGADFVVAGTLDELIAGMNRLTDRPLLDAAHVRGQIEARDRQLANKVTKDAQIQGIHNSRRYLGDKLGRTSAPHRVLDPAAGPLIGVKLHILTRKTLGGIQTDLDSRALAPDGSALPGLYAAGEVAGFGGGGVHGYNALEGTFLGGCIFSGRAAGRHAARSL

SEQ ID NO: 14829 - protein, 228 aa, Actinoplanes utahensis
MSAIRGARDELLDCLAREVGAVAVAHPVRVAVDGPPAAGKTTLADELAGVLRAAGRVVVRATIDDFLVPRARRYARGEFSMEGCYRDAHDHDALKRVLLDPLGPGGDRRLRTAVHDHGADAVCCPPPSPAPADAVLIFDGVFLLRPELVDRWDLRVLVTVSLDTTVERALVREREKASRAAIERRWRERYIPAQRIYFRTAHPVQRADVIVHNDDPRCPAWQVRRAPG

SEQ ID NO: 14830 - protein, 337 aa, Actinoplanes utahensis
MSLQRVLLVAGSVLLLLQIVKFSGVLSAIRWILANGREFIVELRKRQDTFSEAAYWEVLDRCNGRAVPPFGVLEYRLLRFASRRGRAAGVAIRFGRTILYDFTAIGVYVAAFLLITGAPALRNRVHGPVTTLAWISAGLGALQLIAIYAEACVSYARIGSYGLGFHGASRYVERERAGTYFAEVKTLVGAVLYSLLIGSMIFYFSAGHGARYDAFRIAQTTPAGVAGDVLTCVYFAVMTFFTADTPDARNGVAHLATVILVLQAVCALVLALTTATMYIAPDSRPEPPPVDPPAPEPSRLPVQRPARSGPAAFVTGVVIGVVLAGAGLRARRPGRRR

SEQ ID NO: 14831 - protein, 324 aa, Actinoplanes utahensis
MIDEGAGIRRPRLAQAPPRVRLAVREMLGGPVVAEQAADAGFTPSIASVVTGGDGRRLFVKAAPVGDGLGEAVTAGVVLAGVTGPVGPRLVGCASAGRWRVAAYEVVDGTAVTCWRAADLPHLLRVVDRLRKIAQPCPVVGVTPYAEAFVPLLGTWRALNGEGDGGVAVDHLRGRPLPVELPIPLLAGLEGDWLDALAAGTALHHGDLRRDNVIREPGGRLRIVDWTHLWTAPGWLDLVRLGPDLAICGHDPERMLRRSCWRDAPADAVDVALAGLAGRAWREGWLPPVPGLPGLRRMQRRQGLHLLRWLAARRRRTLPPPLAQ

SEQ ID NO: 14832 - protein, 37 aa, Actinoplanes utahensis
MIAAAYPELAGEARRQVAEHAAAVPARPRRSRAGHRR

SEQ ID NO: 14833 - protein, 222 aa, Actinoplanes utahensis
MARRRLAAAVRAELMSVPSFAEVNRIRSAATMRDLIRRDDLPDDPQWWLAVISVGQAALLGAESGQPGARAWAPVLVESLDAAERRPALGVAETVHRRLAACLAAIHYFGTRTGDPVRDPKLVLDHLEAALGGTPEAYLARYRETLATALAEHRRIGAGRGGDRRAVSSARAWLTGTRAALVQMCRELAPLLSGTDAAPDVTVGWQAAVTAIEQIRREAQRD

SEQ ID NO: 14834 - protein, 714 aa, Actinoplanes utahensis
MAIDVANSAILIGAEQSAAAEQHAADAEAAAVHAAEEALRAQEQVKPAYAAAQKAAEDASRAIKASKAAITAANNAATEARATVAAANDAAHAAQQATAYANAAEGMAVQAGHDAAVGRQAAGAARNYANQAKTAADNADSIAKQIKAASDSATTFATAMKNTAARMVQIAADTHTAVHQLADLTEAEKKARQTSWMQTWRDYVDKKLAAKDLPDWLKKFYRGESEEVLGIAGGLWLSGLCAFGAPGNTPGNTPDSEEACDMLKDGVKQLIDHPGSLIHLDEWRNGDYAKALGMSVVDLATLDLPKIGKITAAIDVLRDGIAAGLAKLLSGELLNGLKNIGADLIDAALKKLGALKLTKLIELNVDLPKKITFSADELSALKLAIDVKGFPAVADALKGLIDGKGILDGLDDLIKKCLGDSFTPQTRVLLADGRAVPIAAVRVGDLVLATDPETGVTAAEPVTDLHRNLDTAFADVRIGGRHGDQAVHTTAHHPFWNAGTRQWTDAGALQPGDTLLGRGGPATVTAVQQHTGRRIMHNLTVATLHTFYVLAGATPVLVHNCLPNLRDEGMQKIELDAAAKRGVSPVTIGPGSGLQALKDAISKASPGTEGYFKWGITMDGELKVIPAFAGTTGSGWPRVEIAHTVLAGLKGKLRAAGTGHIDDLFGVEINDSSGHFQPTDGLIDLGVEKFHEAGIDVFPSSWRDGDWLLPFAPN

SEQ ID NO: 14835 - protein, 599 aa, Actinoplanes utahensis
MTRARIAAVVASLLAVVMLPQAANAAVPITPEAVPPAAAPTLQDWIAREAAADADRERRLAADGPIDDTELDRMLIQDLADYDADPDVRAAAAQVLQAGDPAQFAPFLDRALPVYRAAAAERRTRDAAENREIVQDWAATGGPVERQKAAAALATGNDDRIADFIAVGHAAAVAADQQDRITAAEQAKTIKARVEQIVAAGGYEVRWAGQGALDTEDPATIAAFYTTGYAAAAARDTAAQQQIEAALAARTKAVDDLTALARRATQAATARTTIITESVTATQALTVAANSMGLADKYAKQADAVYAADLPIRTAGGATHTADLTRLRTDACTESATTARNAGQVTAHTGVAKTAADTLVTTGLTHGVDWAAVMQAQNDAADAAGQAAATACHAAEATEAAARTLDADHHATVDANNAVKYRQEAEREAAAAAKLAAQAEKLAAAAQAAEADAHQQRLRAEQDARDARSRAAEAREHYTRAKTQRDIARQQSAIAIAQQAAAYDAARRAVEQQNVAAGKGATAKAAADEVTKSIDRFDTLVNDSKAASLRAQKAISDRDTKQLSYEAYQQDAIAKKGTAEGDYAAQQAAIIGAQLPGAS

SEQ ID NO: 14836 - protein, 775 aa, Actinoplanes utahensis
MSVRTVQAGLLAAGLVCGLLGVPGAAHAAPSPSPSASAGVRAAKASAATVDDPTNLATDEDKVKAAGAIGVNPGVDLLVLNDQAFVFALWRRDEAGTNVKAAALRAYESDDPHAAYDFIVTGIFVAANDDAQAKIAEAAAQARRRSVAVTVGLDPSDTALIERNDRDFIFGVWQRVEAGSHVRDAAQAAIADGTTQADWDTFLNTGAAAAADLDIREAIAKADAEQAAKLRAAQLLAAKKSLLQLLLLQVTDELVSAPNRQFVLFVHNNAKGSEVSLASQVALNAPDDQLDKALTDFIFTGGAAANKRDEDAAAVIERDGYHARVIPIRDAAEHDGFSPNLLAAAQAALAANTLVALQTFLLKGQDEARAKDRRLDFGSGFEAADARPNWQNTVDNTGNGHGGTINVGGIVNSVTTSELGVRAEKAHTGSQALMYSGMDNNATKSFAYNQVFGLKGVSVRPTTKLSYWIYPQSSAQMTQVSGANSSCVAVDLIFSDGTNLRDSGAKDQHGNSVHPAAQCGKLTLDTWNEVDVDLGAVAAGRTILRVTVGYDQAANTGGYRGFIDDLSFSDLESAPKFRTSAEPGDTKLTWTNSADTGAKPAGGSLNVGPIVASVTGPELKEGPATGRTGSNVVLYSGKDTSATSSHAYMKGYSLGETYVTPSTQLSYWIYPQSTRSFGGVTGSNSSCVSLDLLLEDKIAATTVSLRDTGVKDTRGNVVHPFKQCGKLPLDTWTQVIVPLGAIANGKRITQIDLGYDQPAGTGGYRGYIDDIRITQ

SEQ ID NO: 14837 - protein, 139 aa, Actinoplanes utahensis
MTAIYTASATATGDGRNGHVRSSDGVLDFDLAIPKEMGGPGGALTNPEQLFAAGYAACFHSALKRVASMQKVTLTDTAITVDVGIGQLPSGGFGLNVTIEAELPGLSEEQATALLEAAHQVCPYSNATRGNVEVALNLA

SEQ ID NO: 14838 - protein, 158 aa, Actinoplanes utahensis
MVTVATNQLCTTKLPTTFLGMRESTALDEMICFQLYAASRSITALYRPLLDPHGLTYPQYLVLRVLWHDGPTTVRDLGRTLRLDSGTLSPLLKRLAAQGHLTRVRGADDERTVLISLTDSGLRLRDAIGDLTQALLCSVNLTVDELTQLHSLLIRARG

SEQ ID NO: 14839 - protein, 167 aa, Actinoplanes utahensis
MPGIRFVKLPPAALSALIDGDLAAASHAAGTPLSRYLIDESWLWRIRLEDVRRDPEAADWIARAAVTDPDGVVVGHGGFHGPPDADGIVEVAYSVDPAHRRQGHAKAMLRSLLDRADADPRVTAVRASIRPDNLGSRATIKGFGFRKIGEQWDPEDGLEDVYLRPTR

SEQ ID NO: 14840 - protein, 367 aa, Actinoplanes utahensis
MPTTAAANRCAGAPSASAHNTVRSSPPDRGCARSTSCSPRTSASSSPTASRTRSACTVPSDSDLPCNRLNVARRTGPTLVDGGWHVHQGPVLHDADLRGRRDARHLAAAGARPQVIVLLLVAAAAAGWVDAVVGGGGLLLLPALLLAAPGLPLPTALGTNKLAAICGTGTAAVTYARRTKIDWGVAGPSAAVALICAGCGALLAGAIPATAYRPIVMMVLIFVAIFVTVRPAMGLAEHGEKRTPVRRALAVATAGGLVAAYDGLIGPGTGTFLVLAFTTIVGADFVRGSAMAKLVNTGTNLGALIVFGVTGHVDWLLGAGMAVCNIGGAFLGARMALRRGSGFVRIVLLIVVLALIVKLGVDQMRMG

SEQ ID NO: 14841 - protein, 157 aa, Actinoplanes utahensis
MSDESQNLIAELKDQERRLVFDHFDEADAWALGCLLVNLATERSLPVAIDIRRGEQQLFHAGLPGSTADNDVWIQRKVRVVYRFAASSYLVGRELAANGRELDAAMGVDPMRYAAHGGAFPVRVAGAGVIGVVTVSGLPQADDHALVLEALETFLDR

SEQ ID NO: 14842 - protein, 320 aa, Actinoplanes utahensis
MRILILGGSGFVGRVLAATAVADGHAVTVFNRGHRDPIPGTTLITGDRLADDGLAGLATGTWDAVVDTWSAQASAVRAAARLLAGRAGHWTYVSSRSVYRWLAPQPLTEQTALADVDDPGYAGDKLRGEIATEAFGGPVLLARAGLILGPHEDVGRLPWWLRRMHRGGPTLAPGPRSLPLQYIDVRDLALFLLATIGAEGPVNVVSEAGHATMGSLLDAANAVTGGHAELRWTDPEPILAAGVQPWTDLPIWMPPGEAHDFMHKGDVSRALAAGMRCRPVMETVSDTWAWLSGLPGAAPLRTDRPAVGLDPDVEAKLLSD

SEQ ID NO: 14843 - protein, 246 aa, Actinoplanes utahensis
MDIPRHHVIREGDLRILNPFSPAKLAVLGRAIKLRAGDRLVDLCCGKGELLRSWHLAHGIRGIGVDLSTAFIAEAREHAAGLPVEFVHGDAAGFVAPEPADVAACIGATWIGHGVAGTIEILERSLRPGGMLLIGEPYWRREPPDQQTVEACHAQARDDFRSLPELVAHLGADLGWDLVEMVLADQDCWDRYAAAHWLNIRTWLDANPHDELAPRMRAELDTDPLRHVRHRREYLGWGVFALRKRG

SEQ ID NO: 14844 - protein, 385 aa, Actinoplanes utahensis
MPIQCIGMRPRIAVVGAGPGGLSFARVMHHHGHCVTVLERDSGPDARPPGGTLDLHEGMGQVALEKAGLLPEFEKLSRPEGQAMRILAADGTVLRDWRPRPDERANPEIDRGQLRDLLIGPLDVRWGHAVSGVVPGAVHFADGRRESFDLVVGADGAWSRVRPAVSPVTPHYTGVTVVETALDDVDTRHPELAGLIGDGSVGAYGVNRSIVAQRNSGGHVKVSARFRAPLDWHAGLDLTDAAAVRATLLARFDGWAAPVLDLVRRGTAFVHRPIHVLPVGHTWAHGPGVTLLGDAAHLMPPLGAGANLAMLEGAELAEAVAAGPEDLDGVVRTFEERMWARAGMWARITTAGLERLVSADPAEAVAQFDRVNQDSGARTGRCPAA

SEQ ID NO: 14845 - protein, 100 aa, Actinoplanes utahensis
MPEPVAALLLEYLGQRTNLRTATNRDSRWPFPGRWAGQPLQSRVLSPLIHALGVPTTSGRAAAIRQHVLTSPNGRVAPRVRSAGHCRSGWRPMPRRTASW

SEQ ID NO: 14846 - protein, 134 aa, Actinoplanes utahensis
MTHGPARFGGRSTVVLAIVLDCGDLEKSTAFWSGVLGYTPGPDGDGPYRRLLPPDGNGVELLLQRVPERKATKNRLHLDLRVPDLQAERERVTALGARLLTEQPIAEEGWVWHILADPDGNEFCILQPPADRLI

SEQ ID NO: 14847 - protein, 101 aa, Actinoplanes utahensis
MLELPAGWDWEIHRYDGWRLTLIGDVDLTYHWNREVIFCDVTHLACPFQFCDPIFREPTPRELASVREDEPAVVVAFDVEDMPCLIAAESVAIRHGTVMRR

SEQ ID NO: 14848 - protein, 104 aa, Actinoplanes utahensis
MAWTVLVVSGLLETVWAIALDRSAGFSRLLPTGVFGVAVILSMLGLGYALRTIPVGTGYAVWVGIGAVGTAVVGMVALGENTSPARIICLFLVVAGVVGLKYAH

SEQ ID NO: 14849 - protein, 266 aa, Actinoplanes utahensis
MRVCGACHHGPPMETSTTWRAPLLWRFLLALSRVVIAPVCRLRVSGSVPAELRSGPVILAANHVSPFDPLVLVAACHRVGLAPRIMITGGLFDAPVVGAAMRACGHIRVDRGTARVAEALPAAAQALKDGATVLLYPEGRIGLDPWMWPERGKTGVARMAAATDAPVVPVAQWGAHRVLPYEAPTRIGRALLRALFTRPVVRVGFGAQVDVSGLSGSAGAQAMRATRLIMEGIDAALAPLRADEMQLPRYVDASRPVDLSRVRRPL

SEQ ID NO: 14850 - protein, 122 aa, Actinoplanes utahensis
MVKGRIVAESLRPGAALVVPGLELARVARVAVAAPGPGQPAVWTLLDVVAPEERSAELAAALSAALAPDGGWYADFRSGGEHVVVFAGRVFRYAVGDGVGRAEAVAYGRSLGVPRAQLDWGP

SEQ ID NO: 14851 - protein, 178 aa, Actinoplanes utahensis
MVGGVLSHRLAVRADLPVLESLVEAAIGELQRGFLDEGQIASSRAIMGLDTALIDDGTYFVVEADGRVAGCGGWSRRATLYGGDHRAGRDAALLDPVTDPARVRAMYTHPDFVRRGIARLILSLSEAAAAAEGFRACELIATLSGEPLYRAAGFVPVERLSDASGGVAVPLVRMRKAL

SEQ ID NO: 14852 - protein, 168 aa, Actinoplanes utahensis
MSEHHPGQRPDDRPTGHRPDDRPTEPGPTGHQPGDSRGATGERPSDLWRRQVSTQTAQITAGQLTPDKAYAAELWPPDFIAAVDLALTAYEDDVREFSPTSSDHDIWTAVERVVLALNEVDDYIETDEREQLAAYVHDVLVGAGVDVTAVAGRRGLHPAELTDQWRDW

SEQ ID NO: 14853 - protein, 118 aa, Actinoplanes utahensis
MDITIDPDSPTPPYEQVRLRIAALAADGHLAAGTRLPPVRHLATDLGLAANTVARAYKELEQAGLVETRGRAGTVITARATGTSLRAQKAAAAYAETTRALGIPADKALALVEAALHA

SEQ ID NO: 14854 - protein, 458 aa, Actinoplanes utahensis
MALTGTPTPAPAGKRERTGWYLYDWANSAFSTTVITVFLGPFLTKVTERAAGCSIDADECHASVHPFGLTVAAGSYFPYLVSLSVLLTVFVLPVMGAVADRSPRKKPLLATAAFTGAAATVAMALVTGDRYLLGGILFLIANIAFGASVVVYNSFLPHLGGPDERDRISSRGWGIGYLGGGVLLLLNLVAVTLFSQDGNPQRTLDLARWSIVSAGVWWAAFTLLPLLWLREHPGADSTPTRGNVVTDGFRQLGHTLKSMRAYPLTLAFLGAYLIYNDGIQTVISLASQFGTEELKLEQSTLIITILIVQFLAFGGALLLGALANRIGARNTILVALALWLVVVVAAFWLPAGAPVPFMLLGAGIGLVMGGSQALSRSLFSQLIPTGREGEYYGFYEISDKGTSWLGPLFFGIIFQLTSSYRLGIVSLVVFFVTGGILLALVPIRRAVIAAGNTPPTLI

SEQ ID NO: 14855 - protein, 160 aa, Actinoplanes utahensis
MSDHWGGFDHHDDGGDHHLPDFDDSHDLPAGHDLTDMSDLHDQHDHDDPGHDDAHHDDAQHDIAEIPDTHHDPVALTDDFPPHLEVGELPEPVDGFPWTDAATLGHAAAYTPTTDPVDPHDLAAYAGLDVPEGSDPWTALTASDDPAISALARWWTPDEQ

SEQ ID NO: 14856 - protein, 600 aa, Actinoplanes utahensis
MRDLTATLDAAVRDSLAYLRGVDMDAAADLAELRRTQLTRPGVVVVGETKRGKSSLVNALLGVPGLSPVDAAVTTAAYLDFVPGPAYSARAWLPEGGDSVPVDDLGAWARGAHRARRIEVTHPAPLLQYLSLLDTPGAGGLDPVHAVVALDAVRRGTALLFVADASAPLSSPELAFLAQAAERVDAVVFALTKIDAFGQWRRIAEDNRALLQAHAPRFAAAPWYPVSARLAELALTAAGDHQSTLAEASQIPALQHALIELAGRGHQLQLANVLRAARGELGRLQTQAETRVQAATADPARQAELRADRAALAARKRTESRQWSLLLNAEVQRARVEAVGGLRSRVADIQQDLSARIDKMRGEQLTHLPDDVDTHLRAVAADLSQRLENTFAQVAETVLTSAFEPDERDAVLGKLNATLRHELTAAPPRDGAGDNMLIALSAGGIAFMAGRGAALGISVLGAAGGLLVPVAGIGLGLAAGGYVLYRRRVHSDRQHARGWLRDVLGEARAALADEITVRFTDLQYALSVALDDATQRRLRDLDAQIADIDAAAAEDTAGRAKRRAVAQQELDTVRVRVRQADEALLRARALTPAPIDERDR

SEQ ID NO: 14857 - protein, 497 aa, Actinoplanes utahensis
MTGPLSTRLATLCHDIVTEFGSAAGGQVRQIGNRLHEPLRVAIAGRLKAGKSTLVNALIGRRVAPTAAGECTRVVTRFRYGPADRVNIVTRDGIHHSLPLDDDGMVPARLGVPATRIAYLDVTLTNDRLKTITVVDTPGLSSTDTASSDRARHVVGDAPFDDDIDADSAGEVAAAEAVIYVFTQAVRADDVRALDAFHDASARLAASPINALGVLAKVDTLAGGAGDPWPVAAPLAEQQAALLRRTVSGVVPLIGLLAETTGAGRLTDADRDALARLAALPTGELTLLLTSTDLLRTLPAPIPADHRERLLGRLDLYGIGFACAQLAAEPRLGTGDLVRRLEAASGIPRLRTTLQQSFGWRADAIKAGWALTRLDRLAGHTGDPRLRAGVRDALETVLRDPAYHRLRLLDAAQRAATGAVRLPADRETELIRLATSTDPRYILDLPQAPEQELATAAIAAAGRWRAYAVDGAGPAQARVAHIAHRGFQLLAQEVRHA

SEQ ID NO: 14858 - protein, 60 aa, Actinoplanes utahensis
MADEAHLAASSTLRHGPGLVVLAGPPGCGRSTLLQRLAATLGGPVHAGGGLAMLAGVPAS

SEQ ID NO: 14859 - protein, 100 aa, Actinoplanes utahensis
MLAGRARRGLRQHGIHRDTRSRRSEGGLTQREQDVLRLVAAGEPTRRIAGQLGISTETVDTHIRASMRKLGARTRTEAAALAFAAAGPRADTSDNSEDGR

SEQ ID NO: 14860 - protein, 175 aa, Actinoplanes utahensis
MNNPPDTPRHVVAGTADAETILRRLVRDGWTARPGFALPDANWDVTAAHLVLHGRVSDDDTHTAGLAVLAAARGAAVIVICDTDSPAGRALIDDLSRIGAVNQDPDGADPVAHLIPEQRALLDRLAAGDTIAAAAAAEFLSLRTANRRIAEARALFGVRTTREAVLAYLRQRQPD

SEQ ID NO: 14861 - protein, 205 aa, Actinoplanes utahensis
MRRYTLAGFVAGHPWTTGGQPWTADLPGTVATVSDCLTAFLPLGRDIEPWQQPLFEPWHRTLRQAARAAERAPGSHVLSMSVPADGSDPLTTMIEEWIGDLPHPIRINLAHPAAAPPGTIRGHEVLGFSGGRFHSWLCYRLDIPAAAELGVQAAGNALLSTLDDARRVADMANDNRGTPDGTPHDITWFPALITEHHDAAPAPQR

SEQ ID NO: 14862 - protein, 110 aa, Actinoplanes utahensis
MTGDGAWNALMPMRPIMPVVTAYPGPVLETVARALFECLMFVELSDDDAVDPDSAVALMESVSHVLLELPLAERLVLVQLAQRQAEQESLPARRDFLASLGGGLGLIDEG

SEQ ID NO: 14863 - protein, 734 aa, Actinoplanes utahensis
MLEQGVKSGLVTGRDAVHRSATDDLDAGAEVIGSQHGDRGTSDRSVGGAGCRLIRLGGARRARIRQIEPEYALLLAEQADPGLDLHGVRIRPAQRPGGAPETCRGAERQSGRGRGDHLPIDTSPGLDDHPAIAVIMQHEYRTSGMPPVRAGLCRPGPPETQTGRQRVVIRASQSVAVPATVVRQSSGGGMHHVQDQTRTVGGRQCRNGGRYRGRRRLEPLANLRIHRHHDIRTAPVEPAEEPQLRMTCRNGRLRHRFAVQLTDTTCAAHERVLVGVLQPGPIREPGRRPEPDHTQVRHAIDHAARQGEPPAVACAMGRTRRRLAPQLANGTGAWSPRVCTVDYDPGHGVPGEAGARRCRSGRRLSRRTRRPPAGRGRPAPDAPRARHDHPAAQRPRDHRQPCPRARRPSVRRRRPAGTGMTLGRGKLAATAAAIAAIGVGIGIGIHGLGGRTITSSSPSPSSPSASPSPSATSSPITTATTSSTSPGTTTADTPAGAPPPGNASFDYQIGGAYTPPTGVTVVSRDSQASPAPGLYNICYVNAFQAQPGTQPWWQAHHPELLLRTADGDPVIDKDWNEALLDFSTDAKRSALTAIAGAWIDRCAAAGFQAVEPDNLDSYTRSAGLLTKNQAMVYATALAGRAHEEKLAIGQKNTAELSSADAHRIGFDFAVTEQCADFDECDAYTASYGDRVFVIEYSTAGFTKACHAYGARLSIVLRDLEVSTPDSPSYRYRAC

SEQ ID NO: 14864 - protein, 129 aa, Actinoplanes utahensis
MSSVVNHITVDCVGDPYDLARFWSAVTGNPLSDDDQPGDPEAMVIPPAGTGPLMLFVRVPETKTVKNRLHLDVKPTDRTRDEEVTRLLGLGARPVTDHRRGDGSGWVTLADPEGNEFCVERSDAERRGG

SEQ ID NO: 14865 - protein, 288 aa, Actinoplanes utahensis
MSSPSLPGGSGNLGGSPVTRFGYGAMQLAGPWVMGPPADRDGALAVLREAVELGITHIDTSGAYGPRITNELIRAALHPYPASLFIATKVGAHRDAQGGWPTARRPQDLRQQVSDDLRTLGVDTLDLVNMRMGDARGPRPGSLAEAFGTLVELQKQGLIRHLGVSNVTAEQVGEAQSIAPIVSVQNMYNLAHRHDDALVDRLAADGIAYVPFFPLGGFTPLQSAALTSVADRRGSTPMAVALAWLLQRSPNILLIPGTSKVAHLRENVAGAGLVLSGEDVAELDGIGR

SEQ ID NO: 14866 - protein, 147 aa, Actinoplanes utahensis
MLRGIEGEEHPVATTTAAQARADARGRYNAFLAVCPSHKMLERISGKWVILILSALGSGPGCDGDPRPMRYSELSRVLAGVSQKMLTQTLRSLEGDGLISRTVVPSVPVTVSYELTELGLSLHHLMRGLKRWAEDHVEAVSASRTPE

SEQ ID NO: 14867 - protein, 550 aa, Actinoplanes utahensis
MDHEYVVTRRGERSGLAVTIAVHATAHGRSAGGCRIKHYPDWRAGLADALRLSAAMTAKCAYAGLPLGGGKTVVTLPPGHRLDAAGRRDLLHDVGDLIEDLGGRYATGPDVGTGPDDMTVIHDRTRHVFCRPRSQGGSGDSSPHTAAGVVAALRAVGTHRFGTPELAGRRIAILGLGHVGAHLLRMLAAEGAVLTVADVDDSRRALADRHGATWTGPDDCLRAETDILVPAALGGVLTAATVPRLRCAAVAGPANNQLDDPRTADLLRERGILWAPDEVVSAGGPAGSALLSLGRAFPLLADAASFAVSALLVRSLPALHRPARQARESLLRQARSGASYVFRDRLLLGLALRPAIGNIAFVAAETVLALFAHDRLGLGTAGFGLLLTAEAAGGLLGAGLASPLRRTLGTGTALTCTAAIEGLAVLGLAAAPNPYAAGLALAVCGAGMGATMVLAPSLRQSIVPGHLLGRVTATSRMLAMCAAPLGAFLGGWLAAAFDVRTPLYVGGGLLLSMTLVTATMTGNRRVAAALRAATTVESHSGVRLADTAST

SEQ ID NO: 14868 - protein, 181 aa, Actinoplanes utahensis
MVHGKKLMRCTSWAICFRTMFARWAIIPAVDELDSAIVAHLQTDARQTNRDLARAVGIAPSTCLERVRSLRERGVISGFHAEVDLGALNRAVQALLHVQVRPLNRGVIESFKAYAMGLPEVLSVYVLAGGDDFLVHVAVPSVDGLHAFLMDKLSGRREIIGFRSSIIYEHTRKPVIDPLDL

SEQ ID NO: 14869 - protein, 165 aa, Actinoplanes utahensis
MLGLIAAGCALGYAPFARLFRQIIEILLFGARHDPIRAATRAGGRLGDDPVPALRSLRESLALPYAALLDAAGEVVAASGTTSATVVRHRLAGLGHLDVGLRTGQSHLLPGAVQVLTVLAPALAQLLHARRLGADLRASRAAMVQAIEEERRRLRRDLHDGLGPG

SEQ ID NO: 14870 - protein, 283 aa, Actinoplanes utahensis
MLIDRAGLAEFLRRRRESLQPEDVGLPRGTRRRTAGLRREEVATLCHLSADYYSRLERGRGPHPSPQMVASIAQGLHLSLDERDHLFRLAGHHPPVRGDAGDHISPGLLRIFDRLTDTPAEIITELGETLRQNALGVALNGDLTRFTGPARSIGWRWFTDPASRARYHPDDHRLHSRVFASGLRQVATLRGPGSRAAQLQQQLLDGCAEFREVWNEHEIGIRYQHVKRFVHPEVGGLELTCQALLDPEQGHSLLVYTAVPGSDSHQKLALLSVIGTQDLTVDT

SEQ ID NO: 14871 - protein, 314 aa, Actinoplanes utahensis
MPRTQPDLTLPDLSDRRAVVTGGSDGIGLRVATRLAAAGAEVVLPVRNRDKGEAAIAAIRRQQPAARVSLRELDLSSLASVAALGATLRTEDRPIHLLINNAGVMTPPSRQSTIDGFELQFATNHLGHFALVAHLLPLLRAGAARVVNQISVAADSHAIDWDDLNGERSYDGMRAYSQSKIALGLFGLELSRRSRRLGWGITCTLAHPGVAPTSLLAARPEVGRDRQTIGRRLIGALSARGILLGTADSASLPALLAATGRDGAFYGPGGPGRLGGAPAEQKLYSRLRGEADAERIWRVSEEMTRVSFAAGLHR

SEQ ID NO: 14872 - protein, 234 aa, Actinoplanes utahensis
MTIRWVTGFLDSPAGLAAAGERFWLAVTGSVMSPRRGGGTFATLLPPAGDPWLRVQVVGDGPARTHLDLHVDDFAGFEVPGARVVDRQDDVMVLRSPAGIVFCVVPWSGEKIVALDRSAVVDQVCLDIPDQLYEVEAAFWTALTGWARTPSGAPEFEHLTPPPTLPMKLLLQRVGAGPAGMHLDWACTDVPGEVARHESLGATVVRRVPGDWTTLRDPAGREYCLTARPPRRPG

SEQ ID NO: 14873 - protein, 330 aa, Actinoplanes utahensis
MGGRRRVRRGFRAPGCGAGVADGEELTLMRRVRYHRHGGPEVLVVEDGPEPVAGEGELLIRAAAIGVTRPGVARVRGGDGPLPAMPGGEVAGEVIGIGPGVSGWAVGDRVAALPFGGSYAEVVAVPAAFAERIPGSFVDAVALVRSGHVALGVLTVAALRGGESVLVTAAASGVGHLLVQAARRRGAGRVVAAAGPGKADFLYGLGADAVVTYDRLPLPDPVDVVLDGAGGDLLGAALGSVRAGGRLIFFASGGGTVPAFDLLAGAKTMTGFTMANFARGNPEVYAGHGRELWDLGLTVCVHAALPLAQAARAHEIVEARANCGKVVLLP

SEQ ID NO: 14874 - protein, 246 aa, Actinoplanes utahensis
MRLAVISDVHGNLPALDAVLAAIAADGVDLTVNLGDLLSGYVQPAETADRLIAADLVTVAGNHERQVLTLPEDRQGMADRITTGLLTGAHRAWLAALPAVVSPAPGVLAFHGTPTDDLQYLLHTVTADGVRDATGDEVRERLGAAAAGPALLLCGHTHLAGSLRLPGGPLIVNPGSVGWPAYTDDRPFEHQMAAGSPHARYAVVDDASGRWEAQLRAVEYPWEVAAGFAEGFGRPDVARALRTGRN

SEQ ID NO: 14875 - protein, 198 aa, Actinoplanes utahensis
MAAATLSGALRDPCVPRLRLLPPEVADLLVSMQAPPRLGAHLRAVHDVAWELTGWLAAAYPGLVFDRAAVLFGAATHDIGKVWHPRELSGPGSRHESAGQRLLLAAGVAPRLARFAASHGVWDAPGLGVEDLLVAVADKVWKAKRVPDLEQLVVERLVAVSGREPWSVFLTLDDQLDVLAAGADARLAYQNGFPVAVG

SEQ ID NO: 14876 - protein, 199 aa, Actinoplanes utahensis
MRSPVLCGCYECAVRKRVTDACARALACCGFTRRRHGILLQADSGWLDLGLTDHQTSVVAEPVVGVRHAVVERILVATAGWDEPVACVTLPLGRGWRFPAGADLSEIAAELAEEVVVRGQPFIDRWSDPVALRRDIGTVVAQQTRHLVVPAVALAGGQRERAVGLVRAEVRQLSGRDDGYAVAYREFARRFTRLAEGGA

SEQ ID NO: 14877 - protein, 174 aa, Actinoplanes utahensis
MIYRRGSSASGLATFNVATHSAHPAGPQPGMSGRRHRSWHSPGRCGGGCHDAAVGEVRVPFHCGTATVSEAVRDGRLLWDVHHRCPDGDQVSCGRDGLPDELRQAVLAQGGRFRVGFPEADRLAVLRVLRRRGVAIGSLDGVRQRGVTGTEAEMELLRQQLAAVGVVVVVERCG

SEQ ID NO: 14878 - protein, 207 aa, Actinoplanes utahensis
MRALDIFPIIMINSQTAATAALIALAAYLIIITALHVLPTGYRLADHAVSDYGVGRYARLFHTGLIVNSLGVLALAAALALAPNLDPPTTPLVYLVLLPVARIGIAVFPTDLEGRGLTPTGIAHYLSAIAAFTLTYLAIDGLTPTLRAATSHPDVPHWLAIATPVLLAAVAVTMFRPLRRLFGVTERLFLLVTNAWYVAAALIVLAR

SEQ ID NO: 14879 - protein, 194 aa, Actinoplanes utahensis
MSDYDERYRSGNTPWEIGKPQPALTALLEHGVRGPKVLDLGCGTGDLACTLARRGYHVTGIDISPTAIERARQKAAGLTATFHVQDATKLDLPNKPFDTIFDSGLLHNLHRNGGPVDQYLAQLPELAEPGTLLYILAISATAGQGWTITREYLQENLPEPTWTDTRIKDVTVTAQVDDTTITMPAYLLRTARSY

SEQ ID NO: 14880 - protein, 171 aa, Actinoplanes utahensis
MRLESARLVLRPFESGDAPGVHAVWNEREFLRFAPVGFRFAGADLSRVADWCARGEVFAGVERSSGRLACHVGLFGADWSAMTVEIHYWTAVWARGNGFAVEAARLVAGWALSVLGFARVTLQTDVRNVGSRRVARGAGFRFEGVLRNASWTRSGRADLAVFSVIPGDVGQ

SEQ ID NO: 14881 - protein, 239 aa, Actinoplanes utahensis
MKLVEDEVRIGEIRAVVVGPSGGGSFPGVLLYTDIFQLTESTLRSARRLASEGFVVCVPEIYPRGELAGVALAFDDAGKARGLAGAAATPTAQFDADRVAVLDYLQARADVSALLVTGFCIGGHLAFRAALDPRVSATVCFYPTGLQDGGLGADVADSLARAGEIRGRLMVVFGSRDPHVPSQARLRIVGALYAAGLDDAELHVYQGGEHAFMRDVGARHDPVLTDLALAEAVSFYRGR

SEQ ID NO: 14882 - protein, 322 aa, Actinoplanes utahensis
MQHEPSVDPPSPLSDLVEEFLAARATRKPSAHTLAAYRRDLSLVLRQVSPAPADPADLSPRLLRAAFARFAADRAPASVARAWSSWNAFFTFLVTEGVVAGNPMSAVDKPRMVAHSPKPLRGEDTPEQLLRVASVADERQRDPWPERDVLVLALALCAGLRLSELLGLTVGAVSGRDGERRIEVAGKGGRPRSVPIDAGLDAAVARYVASRRVRFGRVASVDRLLVDRHGAPLQRGGLQYLVRSCFRRAGIGDRVPRGAQLHALRHTFATRLAEDGANASEIMRLLGHASLATSQNYIEVTAEQQRAAIQSNRTNRVLRELA

SEQ ID NO: 14883 - protein, 159 aa, Actinoplanes utahensis
MPIPAFVLALRAKLGHDPLPLNGVIAVVLDENNRILLVRRSDTGEWALTTGCLEPGEQPADGALREVFEETGVRARVERLLSVEALDLSVAPNGDQIYWLAIGLLCRSVEGDARVNDDESVEVGWFDPDSVPPLPAHQARCLALALSDDAGPWFAAPLD

SEQ ID NO: 14884 - protein, 144 aa, Actinoplanes utahensis
MVDAGRAGRADVRDALAGAGFVVEGFLDHAELPAQGEVWRPFIMSSARPVKWVRHESDDHDARVDRLWHLVSRRNGTIDADGAVLLSLAQGSFGPLPWIRVRVGESLPRVAGFREFVALSPTTWASSAVSEEEYATWILADPLP

SEQ ID NO: 14885 - protein, 250 aa, Actinoplanes utahensis
MAAAGVEARGLTTEELDGIRDALAAGRKPRVQFTEAAGQIAGQIGQVVGLADPAVSDEWVVVRFGRDELPFSPGDLRIAPKGAPVRKVVPVVEPEPEPVLSGPEFLIDKPIGRPVEKPRAAPVQRRGDDDGVVGKDVQDVTAPAPRKVAARSVKAKPSPSLTVTLAYGEGEWTVGATQGAKALAKPYVIRPAEALKMVQLIDVPGVQEAVEQILSAERAEAEQQAQRLRAELAEIEARLAELGEAGQQPS

SEQ ID NO: 14886 - protein, 278 aa, Actinoplanes utahensis
MNIFQAILMGAVEGVTEFLPVSSTGHLTILEKLLGYRLDDPDITAFTVIIQSGAVLATIIFLMKDILRIVPAFFKGLTNADARKHPDYRFALAVILGSIPIVIAGLTFKDAIETTLRSLWFVAIALIVWSAVMAFADYAATQVRHEDDVTWKDALIIGTVQCLAVIPGISRSGSTMSAGLLRDLDRVTVTKLSFFLSVPALTGASLLQGYEEYDNISHGVGWTNTIVATAVSFIVAYFAVTWLLKFVAKHSYRIFIFYRLALGALLLLLLGTGTISAQ

SEQ ID NO: 14887 - protein, 310 aa, Actinoplanes utahensis
MDPMSLLPHVTASATRFTDAWLENRRLSDHTRDAYRRDVTTWLTWCTEHHLDPLQATFLDVNAYARGLEARPMAAATVARKLSGLSSWYAFLVKLRVVTGNPVADADRPYVDRDHSATIGLTPDEVDNLLAAADRQDGPAAVRHRAVLTLLADLGLRVGELVSLDLTDLGWERGHRTVRFTGKGGRPRRRVLTPSAAAALDTYLRVRGTQPGPLFATTTGARLDRHAVFRLVRRLAAEAGIAGADKLSPHSLRHAFATTARAEGVPLEDVQDAMGHADPRTTRRYDRDRHNLDRDPAYTIAAARDRRRTA

SEQ ID NO: 14888 - protein, 532 aa, Actinoplanes utahensis
MPAHLKATGLARTHDGDLLFSGVDLILQDGDRYGLVGPNGAGKTTLLRVLAGDLPPTHGTVTRTPGTRIAHVTQQIPDPDHTVGAYLTAGLGELATVTTTMRTLENRLAAGADVLDAYARAQERWTALQGWTAETRLTEIRQRLDIDHLDDTLPLATVSGGEQARLMLARALLSHPHLLLLDEPTNHLDTDGATWLRDWLQQFPGGVLTVSHDRAFLDATVTRIIELDGIDEHPQDYPGGGYTAYRQEKQRRWERLLLDYEAQEKDRLRWETDIERTKNHARGVENTVRSGAEAPHLRRVARRVARKAKVRERRLRRQMASVRWIAEPRRRPPLTLAFPDDDGDPADTVLAIRDLTLGFGERTLLDHIDLDVTRGDRILITGRNGTGKTTLLRAIAAGHPDVAVLPQTTDHLRTDTTVLDHFRAHVPVYADDAERLLTGHQFDPDQWTARLRDLSAGELRRLLLAILVNSPARILLLDEPTNFLDFDALDVIEEALRRYRGTLLTVTHDHYFADAVGHTRHWHVADRTVIEN

SEQ ID NO: 14889 - protein, 393 aa, Actinoplanes utahensis
MRVSAVASSPVRDLLALVDRPEVISFAGGLPAPEMFDVPGWRAAFDAALSGPAARRHLQYAPTEGDPRLRELVAARMAGRGLATGAGDLLVTTGSQQGLTLVAAALLEPGSTVVVQEPTYLAALQCFAMAGARVVSVPSDEQGVDPAALAEVLVRERPALVYLVPTFANPTGATMSAARRAQVAAVAAGHEVWIVEDDPYGELRYRGTPLAPLTTYGDRGIYLGSLSKIGAPGLRLGWVRTPAALRSALVIAKQAADLHTSTIDQAAAAAYLAATDLDDHVRRLCDGYRLRRDTMLAGLQGITPGGTSWTDPDGGMFVWVRLPEGTDTTALLPVALRHDVAFVPGAPFYAGRPDPATLRLSFTTGTPEQITEGLGRLGRAIDAAFDMLAGSDT

SEQ ID NO: 14890 - protein, 200 aa, Actinoplanes utahensis
MAKLVSTLFISADGVAEIDPAWHFPYFDDNMGRAVSEDYETADVLLLGRSTYDSFAGAWPLREAGGEDDAPFAKQLGDTRKVVVSRQSLEFTWRNSELLGGELAAGVAALKADPQVKGILVPGSISVVQQLLAAGLVDELRLLVHPVAARRGRRLFDEGDTAYHLKVVSTEAFPTGVLRVIYAPGEAPFVAGYEETKGKV

SEQ ID NO: 14891 - protein, 289 aa, Actinoplanes utahensis
MTATAQHTGNTRSVSREQEQMIRDNMALVGHMVREMLFKVPPHVHRDDLASAGYAALVTAAQAYDPARGIPFGRFAAVRVRGALLDELRSMDWASRSVRARARRADVAREELTRQLGRTPTAEELAELLGVAVGELSSVDDDVQRAAVLSLQGFTSGTAEDMVTESAMNPEEMLLHRERLGYLHDAVTVLPERLRFVVEASFLQERPLSEVAAELGVTESRVSQLRTEALALLRDGLTTHMEQVSGPVAKDGCVARRRAAYAAQIAARSTMATRLSATDAQGMRLAVAA

SEQ ID NO: 14892 - protein, 203 aa, Actinoplanes utahensis
MIKLLLADDQALVRGAMAALLDLEPDIKVVAEVGRGDEVVDAARAHEVDVALLDVQMPGLDGISAARSLNEALPQCRVLMVTTFGRAGYLRQAMAAGAHGFVVKDTPARQLADAVRRVHQGLRVVDPALAAQSLAHGDSPLTERESQVLQAARDGGTVADIARELRLSDGTVRNHLSSAIGKTGARTRAEAVRLAVDNGWLLG

SEQ ID NO: 14893 - protein, 385 aa, Actinoplanes utahensis
MAPAPTATPAPSGAAATTRTPSPGFRAGWVFAGIWLFYLGENLNILLHQPDGMWRDTGLVSLLLFAATFLVASTTMRRHRRDGPETASALQIWIALLVMLVFTVLQVPAVGETTLTCGVYIAATAVMGLPLRHGLTVVVVIAAAIELTVRFVPGWQTTSAHGYALAVILAGAATWGMRLAFERQGRLIQAQHELAELAVSDERARIAIDLHDILGHSLTVVAVKAELAQRLLDVDLDRARAELADLESLARDALADVRATALGMRGISLPGEIAAAKAALTAANVQADLPGAADDVPTRNRELFAWTIREAVTNIVRHSRARHAEVRLSPNSVEIVDDGQGAVGNDNPGQGLAGLRRRAEELGAHLTAGQRGDRPGFRVRVEVPS

SEQ ID NO: 14894 - protein, 264 aa, Actinoplanes utahensis
MTAVTVDRSRTDRKLPKFGGFNLGMIALELRRLIRNKRTVIFSVVMPPAFFLLFGTSADYKHERIGDGNVTAYVLISMAVYGAMLATTSGGAMVSIERAAGWSRQLRLTPLKPAAYVAIKLTLAMLIGLVSVVVVNVTGLFFGADLPVAQWLACAALAWVCALVFAAFGLFMGYLLPSENVMQILGPVLALLSFAGGLFVPLDQFGSTFAAIAKWTPVYGVGELARYPDTHDGQLWQAVLNVVAWTLVFAAGAMWRFRRDTARV

SEQ ID NO: 14895 - protein, 322 aa, Actinoplanes utahensis
MVRQHNVPMTLTASTDLAASGTGQLAVNLDGVVKRFGTVTAVNGIDLRIRPGEVVALLGPNGAGKTTTVDMLLGLSQPSAGTVQVYGRAPHEAVALGLVSAVMQTGGLLKDYTVEETVRLTAVLFGKPRSSVQVALKRAGIADIADRLVGKCSGGQQQRLRFAMALLPDPELLILDEPTTGMDVGGRREFWDAIRQDAEGGRTVIFATHYLEEADAYADRVVLVRRGRIVADGTAAEVKALAAGRTVRATLPDAERADLSQVPGVETTEIRGDTIYLHGRDTDAIARYLLTQTEARDLEITSRNLEDAFLTLTADDDEEKPA

SEQ ID NO: 14896 - protein, 211 aa, Actinoplanes utahensis
MGTLCWRTIVLSPAMRHGSPMTSVSMCFVRRRPSTTLSGMEPTHSALIVPVPEAEPAVADLRARLDRAASWGVPAHITVLYPFLPPAQLTPQVLAAIRLIAAGVPRFYLTLDRIGWFDDRVLWLSPSPAEPFRELTNRLAVRFPQTQPYEGEFADVIPHLTVGHDTPGLPEAAAQVQPLLPIRARVTSLRLIAGRREPGDSWHTLTDFPLG

SEQ ID NO: 14897 - protein, 293 aa, Actinoplanes utahensis
MVTQPVPSRRRWFRRTSRSSSSGPSSSASAGRHRRGVRSIPSPYAVNSRLTPAIRQPKVDGMTQIDPPVRLDDLIAAISRNRPDDPLDRLSDAVLLGDHLGELADHLIGHFVDQARRSGASWTDIGRSMGVSKQAAQKRFVPREKLDPSQGFNRFSEAARAAIVASLNLAKAHGNPEISPAHLALGLLDQPQGTAVTAIMAQGLGIDEIRQRLTAVLPAPAGEVPELVPYDARARKALELTFREALRLSHEDIGTGHVLLALLEEEQEDGTLRNLGLSKAAVEQVVASEPADA

SEQ ID NO: 14898 - protein, 117 aa, Actinoplanes utahensis
MSQTRTIRVTVRGSFDNLTDKQKTELTANGGDDLLTAQYTEQGHLTYDIAARPFFTFRFAEQVTEEKEIPQAAINAEMKAVAWLEEHGYGYKKITSQTVDMSEVPLGKRGRREAAKS

SEQ ID NO: 14899 - protein, 205 aa, Actinoplanes utahensis
MIIPVWDMDGTLIDSTEAVPRAFVQAVAVLGGPPVTPADVVGSYWRGTNEVILTHLVGRPLSPAEQEIYFRQLDDVSVPVYPGILDTLCALHAAGLPLVVFTGASTRAATLLLHAAGITCDLLIGGDQIRAPKPAPDGMLLAADRLGVTPDRLIMVGDSPLDLGSATAAGSRSAAAAWGHMHDPAAPADHTLAAPGDLLPIIGCR

SEQ ID NO: 14900 - protein, 272 aa, Actinoplanes utahensis
MTRRLLITGGSGSLGRRVFARAAAAGWEPIGTYVAAPAPTASVHLDIRDPAGIRRVLADLRPDAIVHTASGRDRNDWPSTADGAAHLAVAAAGIRLVHVSSDAVFSGREIHYDESALPDPVYRYGAAKAAAETAVRAITPSAAVVRTSLILGDGNGAHEILTRALIAGRARGALFTDEIRTPVHVDDLADALLELAAGDYAGILNVAGADPISRYDLGVLVARREGLDPAAIPATTLTARGLHRPGDVRLVVDRAEQLLHTRLRGAHEFLTA

SEQ ID NO: 14901 - protein, 300 aa, Actinoplanes utahensis
MAARLDCMQLTGVLVPMITPFDASGAVALPALERLAHEVLEAGAAGLVGLGTTGEPSSLTPGEQQAVLAVLSRVATAHHVPLLAGGPVSAPPRGAVSASVGSAVSAPADAGLSVVPPFVRPGPDGVVAHFTALSETSPVPLVIYHVPARTGQVLDAGTLRRIGSLDRVIGIKYATGSLDPDAVALLADPPPGFAILAGDDALLSPMLALGAAGGITASAHLATDRFAALAAAWQTGDLDTARKLGHLLAPLSAALFAEPNPSVIKAVLHAQGRIPTPSVRLPLLPATPESRARAVSLLPD

SEQ ID NO: 14902 - protein, 300 aa, Actinoplanes utahensis
MLDVRKLLLFCDLERLGTIAAVAAARAYTPSAVSQQLAALEREAGVPLLERTGRRVTFTAAGRILARHATAVLATLEEADAALAAVRTGPAGPIRIGAFPSAMRALLPQVLVALGRDHPALELTVTELDPVAVPAALLDRSLDVGLLNDYDIAPAGTDPALESVPLLQETVYLAVPAPAGAGTLAAAADLPWILATPGTLCHEVTLLICRTAGFRPQARHHADDFATVLALVAAGQGVSIVPELAVPAAPAGVRLTALDTRRRTRIAYRRGAATHPAVAAVITALDTATRTAPTLSGAPR

SEQ ID NO: 14903 - protein, 314 aa, Actinoplanes utahensis
MGRMTVADVYREFAATEARGVSPIYERLARQVAADPELLDRLAMLPAPKRQPNLLFAVVRLLGGPVGDPAGFHDFALAQWDAILAQLMVRGTQTNEIGRTAALLPVLAALPQPLALIDVGASAGLCLYPDRYSYRYGSHVVGDSGPLLDCAATGFTPPDRLPRVVWRAGLDLNPLDVTDPDDVAWLDALIWPEHTHRRDRLRQAVAIARADPPHLVRGDAVTDLPALAAQAPAGATLVVYHTSMLYQLPDRQAFLDVVRALPARWVAVDGDIGADLPEPPTADLYNVLALDGEPLAWVRGHGQSVTWFGAHSLT

SEQ ID NO: 14904 - protein, 501 aa, Actinoplanes utahensis
MRRLLVATLATALTLAATGAAAQAHPRVAAPAPGAPGIGDPYYPDYGNGGYDVSHYDIRLRYTPATDKLTGTTTILATATQDLSRLNLDFVLDVSTVLVNNRPATFAREGDHELVVTPARTVAKGGALTIVVTYSGVPSTKVAGGFTAWTRTPDGALAVGEPEIAWWWYPSNDHPADKATFDVSVSVPDGVEAISNGVQPRPPVRETLGYTRWSWRSLKPQATYLTFLTIGQYDVTTDTTADGSVVYNAYSQLLSPDFRDAAQASVERTAEITDWESTVFGPFPFEARGGIVVPPNTINFALENQTRPNYSAGFFRRGSNTYVIAHENAHQWFGDSVSVRTWQNIWLNEGFASYAEWLWSEKNNEGTAQEIFDYLYATSPDDAPVWTTAPADPGTAELFGDAVYDRGAMTLHQLRLAVGDDAFFQILRTWTATHRYGNGTTPEFTALAEKISGKDLDALFQAWLYTPAKPVVATAARSLSAPVAPKSWAAIKQTHALLHEH

SEQ ID NO: 14905 - protein, 285 aa, Actinoplanes utahensis
MRGRRHRQRDDHRTPLGWSGAELPAGHRRAAGRRRIPRRPRSAVGCRRQTPRRLPDGGDRPRGRRRRGHRGAPASGGDDHRVPAAAAAGAATVGVELLRSGRGSAQYRARLSQDGEPCAESLLTQGRLDDAAPWWSGLPVPDLPAEDDCFLLPSRPPGAAFPVHLLDVVDHRLDPSCLGFAVGQPSSTGQVSGWLRLSDGTDWDPWSLLVALDPSPPISLTLGIQGWAPTVSLTAYLRRLPAPGPLRMTMRAAEVTSGRMDETALLWDSKGALVAQATQLAAVRP

SEQ ID NO: 14906 - protein, 389 aa, Actinoplanes utahensis
MRDAVIVDAVRTPLGKGKPTGAYAGIHPVSLHAHVLRALIARVPDLDPATIDDVIGGAVGQVGEQSGNTTRLAALAAGLPESVPGVTVDRQCGSSQQALSFAAQGVISGAYDLVIASGSESMSRVPIGSQTLGHDVGGPLITERYDGGLIPQGVAAELIARKWGLSRAQLDEFALLSHHNAARAWSAGRFAAQVAPLAGLDTDETVRPGANREAMSALAPSFADPRWERRFGVIDWKVTAGNSSPVNDGAAALLITTGEYAARHGWRPRARIHTAVAVGDDPIHMLTGIIPATAAVLRRAGLTLADIDAFEVNEAFSSVVLAWLAETGADPAKVNVDGGALAIGHPLGASGARLATTLLGVLERTGGRYGLQTMCEAGGTANATIIERL

SEQ ID NO: 14907 - protein, 198 aa, Actinoplanes utahensis
MPRPATPGSRDAILHAASRLFYSHGVRAVGMAQVIDAAGCGKNLLYRHFPSKTDLAAAYLKLVRADRDRSADIALNGAADPGSRLVALVGEVAALVRGPHYRGCAFRNYLTEFPGDDDEPARIARAYLRDTRARIDDLVAARGLAPVTADRIWLIVGGLYAGPADQAEVAVDWVRELVAQVGYPTGSTGSPRHGINNG

SEQ ID NO: 14908 - protein, 330 aa, Actinoplanes utahensis
MEVAAWLWTVTLVGLGALVLADLALVSRRPHEPSLRECALWVTGYVTAALLFAGFLWLRFDGAAAGQYLAGWLTEYSLSVDNLFVFVIIMSRFRIERRHQQKVLLIGIILSLLLRGVFIALGAAAISRFTGVFYIFGGFLIYTAVRLFGYDTDEPEYAENIVIRWARHVLPMTGSYDNARLTTRDARGRRRLTPLIVVFIAIGTTDVIFALDSLPAIFGLTDQPYLIFTATVFAMMGLRQLYFLLGGLLDRLAYLSIGLSVVLGFIGVKLVLQALADNNLPFVNGGDPVDWAPHISIGVSLSVIAGTLSITALASILKARLDASKISSRR

SEQ ID NO: 14909 - protein, 108 aa, Actinoplanes utahensis
MNIRKPFLGAALTTAVLAGTLGVSRAAQARAADWSTVAAPYFALVFDEYGGPTTIGHTQNEYVYAVCQQDGIWGWQTNAYVPSLSAYGWIRNGDLFGYTNPAEGLSVC

SEQ ID NO: 14910 - protein, 156 aa, Actinoplanes utahensis
MGEGEKTRVIAWNRELRSVHGRLREALAVTRHALAAGEAVEPATRDLLLFCHGFCTALAAHHEGEDHHLFPAIVEQHPHLRETLRRLQQDHSMIAHLVGGLQSAVARAAPPAELHRHLDGVAAIMESHFRYEERQLLSILEGLALDVEPHSALGPL

SEQ ID NO: 14911 - protein, 226 aa, Actinoplanes utahensis
MNRLAVVTGAARGFGAALSERLAAGGWDVVACVRDAGAAAGRGRVRVVRHDVRDPVGEELLAAVGERAVDVLVNNAGIGAPGRPLAETDPATILAAVDVNVAGPLRLAQALAPRLLQARDPLIVNVSSRLGSLTAQAAGVFAAHRTSYAYRISKAAQNMLTVALAQEFAGRIRCWAVHPGALTTAMGGRDAATDPVDAAERLAALLDRHDQTSPRYFSLDGPELTW

SEQ ID NO: 14912 - protein, 660 aa, Actinoplanes utahensis
MPVEFLTDEQASAYGRFPARLTPTELEGLFFLDDFDRDLVARRRGDENRIGFGLQVATVRALGLFLADPLEVPTEAVDYVARQVGVADPSRVKGYLRREKTRFEHQWEIAREYGYTDFAAAEPELIRWVDDQAWTSGDGPKALFDVAVGWLRERKVLLPAVSTLARLVAQVRGKATDRLHERLSGLVSAEQARLLEGLLDVPEGSRFSQLERLRTPVTRTSGIGMVRALQRAGEVAGLGLGGLDVAMVPWRRVWELARYGLEAKAPTLRRHPYPRKLATLLATVRALEARSVDDALELFDVLMTTELMSRAERQSKKEKLRRYPKVSRHAGKLAAAVAVLLEAAEWGEQVRLQQVWDAIESKVSRAELRAAVAGIAEVLPPADADPDGEWRAHLLERMATIRGFVPMLCQVIEFGATADAAPVLYAVNGLPELLDARQGRKVAAGFLDARRIQVDVVPSGWWQRLVFPKDRPPGTVDKAAYVFCVLEQFHQRLKRRDIFAAVSERWGDPRARLLDGDAWQQAKAPALNALQLPEEPHDLLQAHAVTLDEAWRTVAAGLSADTAARLDDEGRLHAQKVTAIPDPASLVDLRHRVQAMLPRIDLGELILEVMAWYPGFAAAFTALSGSATRLDDLHVTIAATLTAHALNVGFARSSPTASRR

SEQ ID NO: 14913 - protein, 334 aa, Actinoplanes utahensis
MLIDAQDGIGMARAWGGGLVAAADGMRFVVPVRSVHARPNPKYFGQRRGATWLNMVNDQAVGTAGRVLSGTPRDSMHLIDLLYRRDGGRRPEVIITDTGSYSDVVFGLLQLLGFDYRPQLADLPDAKLWRIDRSADYGPLDATARGIIDLDRIRRHWPDMLRIAGSIHTWQVSAYDVLRVLSAGGNLTQLGEALAAYGRIFKTLHVLTFVDDEPYRRQIKGMRNLNEGRHDLARHVFHGRRGELHRAYHDGMEDQLGALGLVLNCITLWNTLYLDLALAGLRAQGYPVLDADVGRLSPFVRHHIRVHGHYTFTLPDLGGRTYRRLRDPDAGDDE

SEQ ID NO: 14914 - protein, 414 aa, Actinoplanes utahensis
MAEPAHRHEPHGVAPEHHGHGHDHGHEHPHGESHGHDHDHGGHEHGQGLWHRLQHMITPHSHDSADKVDSAMEASRDGMRALWISLAVLGATAIMQALIVVFSGSVALLGDTLHNVADALTAVPLGIAFMLGRRAATRAYTYGFGRAEDLAGIVIVLVIAASSITAAWLAVDRLLHPQPMTHLPWVLAAAVIGFAGNEIVARYRITVGRRIGSAALVADGLHARTDGFTSLAVVLAALGTWAGWSWADPAVGLAITIAIAFVLKDAAREVYHRLMDRVDPELVDQAERTLRAIPGVHDVSGLRLRWIGHRMHAEAAVVVDANLTLLAAHEIAADAEHQLTHGVPRLTGVTVHVDPDSHPGGQHHTDISHDRRDRITASVATTVVPAKPVNRALALLSSSPIYSSSPASGSRSLR

SEQ ID NO: 14915 - protein, 124 aa, Actinoplanes utahensis
MHARDNMASASDLQQRAVSDNVIGAATLALGMLADATRLRLMVALLAGEQDVTALTAAVGAARPAVSQHLSKLRLAGLVAARRDGRRVIYVIADEHVARLVTEAVYTAEHRVSASPDHHLPPQR

SEQ ID NO: 14916 - protein, 122 aa, Actinoplanes utahensis
MLSWGTMIYGAALSALLAAVLVAAAVRPRRPAVIATAAIGALLGPLAWNAILRAAHGAQFFTDAPVAVLPASWQDTGSGVFTIAVTALALGLGPLAAGTGRRLAATAALAGLAAFLIDVYLY

SEQ ID NO: 14917 - protein, 320 aa, Actinoplanes utahensis
MDTTRRRLLQAGWTVPAAALTVAAAAQPARAAGDDHAGDCHGRLAPVVTAAADWAPVAQALGREGKLLDDGRVYRVGFARRDLTVVSGAVTIKPALSLGSYAAFTRYRDGQVLLMGDLVVTEQEMPAVTDALQAAGLAQTGIHKHLLAHEPQLWWTHIHAVGDPVSAARGVRAALDHTGTPPPAPANTTPGELDTAALDQALGRTGAWDGGVYKYTIARAETITDHGRTLTPGMGVTTGLGFQPAGDGQAAVNGDIAMRADEVQPVITALRGGGVAVVELHNHALHDEPRMFYLHFWGHADAQALARTLRAAVNATATTP

SEQ ID NO: 14918 - protein, 632 aa, Actinoplanes utahensis
MGHPCRRTHRPGRMRLADPPPHRPRRRVRVRHRHDGGPGRCDPVRHARRGSGPPRRRLQLRNDRAPLRTHRPDPVETRRDRARSRPRRRTLRRPRSPRPRRDPARLVDDLRRRADPRPDRAGLRRPVRVPPPRPAAEPPTCLSISRHPHARPSSRKALMNSTDPSSHPSAAPTGPAPGQQPARDVVPFGEAVKAWLVISLQTFGGPAGQIAVMQRHLVDERRWIGQKRFLHALNYCMLLPGPEAQQLAIYVGWLLNGLRGGLFAGTLFVLPGVAALLALSAVYVGFGDTTVVTALFAGLAPAVVAIVAQAVWRVGSRALTTKILVGFAVAAFVALAVFGVPFPTVVAAAGVTGWALHRWRPALVAGGGGHGGAQDGPQPLISDDALHDDRPSARRALTILTVGLLAWFLPIATVAALTGVNSVYTQQGLFFSGTAVVTFGGAYAVLAFVAQRAVEHYGWLAAGDMVRGLALAETTPGPLIMVVQFVAFLGAYHHPGTVNPWTAGIVASLLTTWVTFVPCFLFILFGAPYVERLRGNHALSAALTGISAAVVGVIANLGLYFAVHTLFTDMHEVTSGPLHLQLPDVATIRPVPVGIAVVSAGLIFRLKWSVLRVLGISAGLGLAAGLAGLPGI

SEQ ID NO: 14919 - protein, 378 aa, Actinoplanes utahensis
MFSQRVLTQARRSAILRNVCASIPGMAEPENRESDSRDAAAIERHPCPRCLAQPGSPCRSRSGVVATSYHTGRFTRVGRLSKALRVLTPAGRGPGQPWRPGTPPLTLIPADLPSADIRIGYARCSTMTQELQSQLDALAAHGIPRDKIFSEKISTRMRIRPQFEAALALAREIKAHAPHCRVILTVNEMKRLGRDAAELTALADHLVAHGLVLEMLAGPLPGIYDPTGPGRILFAFFAALAETERDNIREGTLEGLDAAARQGKHGGRPPVITDDMLHTVLRRRANGETVERIQPDLIIPTGKRKGRNPSVASIYRAIAAYEKAQGYPDAIEQAHAEHAKRASDRLPAIVRPRPARVLDPIDPELAARIQGRPLDRIE

SEQ ID NO: 14920 - protein, 296 aa, Actinoplanes utahensis
MPAGKARNRVPGEQHCRPRWSRAAWHEFSDPAPPTVRGVPAAAECVASTTVDWLTPDRYLSALESETTRLITAIRGRAAGEPIPTCPDWTLRDLVTHVGTGHRTATGVIRSPSPTPPAYAVIPAPDDPDDWPGWLSSGAADLIAAVRDVGFDTTVWAWVPKYPIAGFWARRMLHDLIIHRFDVAPGGDLDQDLAVDGVSDILLCCATLSARPQPRMAGLRGAGETLRFSDGRHTWHATLTPTGAAWTDTPDVTVPAAVTLRAPAKELLLTLNRRREPGPSTGDRALLRRWLANSRF

SEQ ID NO: 14921 - protein, 771 aa, Actinoplanes utahensis
MTSTSSRITTDDAQAHWYEERAAQATSPWMFSPADDQATRREPLWSGSCHDARFTTVQGHDSVWVLATAGDGARTALRVAYCPGGLLRTVDVEPAGSGVRLRVESAIGTFRTEIALPDSDVALLHATTTLTPAATLSVPYWPRDLIPLGDGDALTDSAGRVYAYQEGVRTGCVHFSVTRPEGAGSIYYFQNLTALNDYAEQTTTSLAGVVGGAWPELGLSLPVSVDNPLRAGQETVLSDAYVLFWPSIPDDDTGMAEQFLDSLARILLLLPHREPAYMPWPDIAEKALRDLSQAAGCSTRIDGHRFLNAYVGDVDTPPESMVQLAVLLPLLEYAEWRGDEIALTGELLDGLPGFFDDEAGVMGRWLMARKDRLDGSEPQKKPGTMDSWYLYHSLLNLARLARHGDRTARRLFLDSMDFAVEVAHHFEYRWPVLYDMYTLDVEVARSGEDEAGESDVAGLYVHVMLEAFELTQDRRFVTEATVAADRLAGLGMRMFYQANVTMFGCAALLRLAELTGEQRFRRLSYVALASAFNNTWTWECDYGHAAHYPTFLAMLPLRAAPYIAVMEAIEAFSAVQYYLRSFSEPMPSWMTVLLPQFCRGLLERAAFYYPQNLPDDVISDEQESGSLDARLWIPLEDLRDGWERPGQVGQEVYGAGVPFALVPRQYRRIPEAGLLVFTDYPIAAFTVGTGRATLRVTGDARFTCRLLLIPDDPDRTPQVSVSDAADGGLVPADRTSEGYLDHRLRGDQAVIIRWQPTENEEHVHDRHRAEA

SEQ ID NO: 14922 - protein, 258 aa, Actinoplanes utahensis
MTATAQKHEPATALLPESVAGKNILITGGSTGIGRATAELLASAGARVAIVGRHQPELDDATHDIHAAGGDVLALRADLTADRDVQRVFAELDRHFGDVHIVINNAALGAGSIAEGTYEQWEYVVRTNLLAYLAVTHEAVTRMREQGSGHIVCIGSMSADVREKGSSVYVATKSGIQGFTEALRKEVNEFGIKVSLIEPGAVGTDMQAQFSPQQQREQIEAMTMLDARDIAACVLYTLTQPRRCDVVDIKIRPHRQEI

SEQ ID NO: 14923 - protein, 234 aa, Actinoplanes utahensis
MFSAVLGWFAAALSIALMWPQVWRSCVLRRTAGLSPTATWLGFALPVGWVEYGLLIDDPVQIYTNTVGAGAGIAVLVALLAARAELRQRRFGARAAVGAAVLLSATALTAGLASLPGGEHRTLASVLGMVLTVAVVLANVPQPLALLRDRRQDLSGVSGLRWVLASAANLSWAAYAYSLGQGAVLVCSLTGLACSLVVCTVLVSARRQRAVPPVAASAVASVPRAADQLAVAAA

SEQ ID NO: 14924 - protein, 410 aa, Actinoplanes utahensis
MAFYTTGLVITPRPGMTAMIRIGASAAPAIRRVRRVGPRLSWRATRLRDRLANRIEEAPRMRAAVKTADGTFTVEQVDSPELPGPDWARIRVRVAGVCGTDLRHWKVPDPAVTGRVMGHEVAGEVAEVGPGVSDLNPGDRVVVETVMGDGVCPWCRVRRYNICPHLYDVRTRTVSRAYAEFLVAPRAKLYRLPERISFEEAALVDTLSVCLHAQHLSGLSIGDRVAVLGAGPIGLGQLMLAKATGARVIISDVVASSRRMARELGADAVVDAANEDVVARVMEFTGGRGADVVFECVGGPAMPVTLPQATRAARRGAAVVVVGGFDEGDVEIALPWQDIQKSEIRILPSASFAVHELDPEQGMVVDLLASGMLDAQRLITHRFPLERINEAFETAADKSGTGAVFVAISV

SEQ ID NO: 14925 - protein, 215 aa, Actinoplanes utahensis
MTTAPTGIPAGIEHPHNRIRVGYARVSTRAQDHQAQLDALTGAHCREVVVETASTRGDRPKLRATLARLQPGDTLVIYKPDRVARSMKELLIFVEDQLHARGIVLEILTGVCAGVHRPDGATIADRLLFAELERELIRERTLDGLRAAAAAGRRGGRPVAVTADQLDIARARLSRGESVTAIAAHLGVGRSTLYRALDLAADAPNGQTRTETDTH

SEQ ID NO: 14926 - protein, 478 aa, Actinoplanes utahensis
MGDAGNAWVTVTRTDRAGVVCTVHGDVDQDTRAVVTRELLAAVTASSPPDVVVIDLSAVAFLAAAGLHVLGEVAAVCSERRVPVRLVSAPGACTTRVLQLCPPGGDVPVFGSVADALALGQAAHAPQPSASAVPEPLHRFVGAPALPAVAGPAWRSRPEQAIIDAEMRASRRAILALFRRRLRTDVATLVAPDFLVLADEPLVFSAITTAAFGVADACDVQTYDPVTRSLQVVAQRGLPRAFVEHVATLDVTAGSAAGVAARTGEPVLVDGVAASRVFDGQPTREVLLAAGSRAVHSYPLHDDHRRLRAVLSLHYHSAGRHPGQELLAWYAEQALSRVALPFTLAADAGQLMTESMSAGIAVAASDASTTTITVSGSLDASTAPELTDLIHQTLNRLTTPHAVHMDLRQLQHLAAAGGRALIQAAERCHAHGVDCYLIMGADDPARTVLTRLQAPSSLRIVEDVHLLRGQQGQGPAAP

SEQ ID NO: 14927 - protein, 670 aa, Actinoplanes utahensis
MQNSSANDLDGLVGDAQTVRHTFESMPLIMIEWAGSDHRIAAINAAFRRIVGREHERLVGLPTREATPELAGQQVFEMFDEVYTTGREQVAREWRLQVSAGPGGELREIFLDFYLVPVYDDSGAVVGMRAFSTDVTDRVRERQAAQERTAAAEHRYTQARDVINALQRQLLPPGLPVLPSARIAGSYLLADAETAAGGDWFDAVPLAGGRVALVVGDVVGHGVAASAAMGQLRAVLQDRLDDSGDILTAMGAADRMARRMPAARAATVCIVVLDPVDGALSWCSAGHPPPLVVNADAARFLPSSGTAPLGTGGRYTVSSDQLRAGEMVLLYSDGIIERPGREPAAATVELSQVAVDTVAGRGMDTDDLSAVERACTQILELLVRRTGHTDDITLLAAQRRTPSPPLHLSGPTATVTPRAARAAVEDWLRLHEAGEEDLVALTHAVGELVTNADEHARPDTADATVTVTAELRDDGEARLCVADNGRWRHRDRPGDEQFRAGHGFGLAMTASFADDLDIDRGEHGTTVSVRRRLYRPARLLTAEQINHERPPADEAPKVMIILDQPHAAGSRIAIHGPLDTDTVDNLRTELDRYTLGGTHELTVDLTGVTHLASAAVAELYRPQQYDPARPYPLRLYAPAGSTAHHVLSLINLPHTTTDPDGNDNDPQPPR

SEQ ID NO: 14928 - protein, 280 aa, Actinoplanes utahensis
MGRRLHRGGVGLHPLRGVRPEHLHRVAFALRRPRRAHLLARRAQEHGHSLAADQLHRLRGRRDGRGRDAARHHHGGRGQLRRLPQPIRGRVRHYPAARFRPAAPDQADQQGPALPACRGRGGRVPAARAGTASTEAILRRFTRANAIHPTYQAMIEVGRAQRTIFVARYLRDRDLQREINEGLNVVESWNRANSVIFFGKGGDIATNRRGEQELSVLCLRVLQAALVYVNTLMVQDVLADADWAGTLTDADRRGLTPLFWTHVALYGEVKLDMSSRLPLG

SEQ ID NO: 14929 - protein, 538 aa, Actinoplanes utahensis
MLGAGPFREIGRPRVTAISPHESLIAVGGSLDRPQWHGRDVSDRSRPHPGWHPTAVYRSDNLTCVFHMTTRWPANALAFHPTLPLLAIGTGAYDGGWSYNGELLLLDLTTGATVSLLADPREVRQLTWQDPETLALVLAVPCDEDEERFGTTSLACTIRRDDWSRATAGMLRMPYGEEPYMDECRTGPAAAAAAIERLCSARGLAWTPRRAVWAVQALPDGRILAALEGIALECWTPTSESPAWQVPIDGTGCQVTTLPDGRTAVALTQTPPAFHGGRWTSEPSVVVEVDLNEGTVRNTRQAASPAIVVSRADGRWALRNTEHDTATMTGEVTFIDPGDAQPTTVHLGRYDLFNHYFDIRYAPDLLFLQGVGSKPWRDKWVVAVDVPRGRIRRLFPLEWDASRGGHLFGGCGAYLSDRAGPALLHTGAVHDGAGLLTGNAFVARRAYPTGELQWVFTADHQATALDADGDFVYVTFNSGELVILRAVDGAVQVRQQLQVNGYRVIPLSLARVGANRLVVGTLDGRVLDCSIAALPRSG

SEQ ID NO: 14930 - protein, 112 aa, Actinoplanes utahensis
MTTLITREQLRAEIDAGTVTVVDALGGDYYAQQHLPGAIALVEADVADRAGELLPDRDAPIVTYCSNPACPNSQRVADKLTALGYTNVRKYREGIQDWVTAGLPVESGQLAG

SEQ ID NO: 14931 - protein, 213 aa, Actinoplanes utahensis
MPQDISGPQSVYASAAEELLLLRSSPPTERADAARNRAAVLDAAAALFSRHGIEAVSMDAIAAAAGVGKGTLFRRFGDKAGLAVALLDEQERSLQEAILFGPAPLGPGTPGDDPGVRERLRAFVAAYLDYLLAHLPLVRMSETASPGARYRIGAYRFWHRHVSLLLQDRDDPQADAHTLLAALAADHVHAVADEIGATRVRQSVQCLADVLTA

SEQ ID NO: 14932 - protein, 67 aa, Actinoplanes utahensis
MPYINVKITREGVTREQKRRIIGEMTQVLVDVLGKDPRTTFVVIDEVELDDWGIGGLPVPEFRRNGR

SEQ ID NO: 14933 - protein, 135 aa, Actinoplanes utahensis
MTVAPAGGAVGFPDVEGLLRTYFDGLYRGDVDRLAAVFHPAALYITQTPDGTLHRDLPTYLDVVAHRTAPAARGEARNDRIVAITQVAPSLIVAVVECSLGDVDYTDVLTLLDADGRWQIVTKAFHATPRRHGKD

SEQ ID NO: 14934 - protein, 245 aa, Actinoplanes utahensis
MSSSSTVIITGGSSGLGLAAARRFLADGYQVVLGGRDDARLKQAEYDLSAGDRVATVAGDIGAADTGQRLVRTAVDRFGGVDVLVNSAGTFAAKPFLDVTGEELDGFLAGNLRGTYLTTQAVVRRMVAQGRGGCVVNIGTVLNDHAVSGFPASAALVSKGGIRALTVALAAELAPNAIRVNEVAPGVVRTPLHAAVDVDAFAGLAVLDRVGEADEIAEAVHYLATAQFVTGHTLAVDGGFVTVRS

SEQ ID NO: 14935 - protein, 41 aa, Actinoplanes utahensis
MMITVEELLMAHPVVEGDRSDPAGPSSSDATEKPTDQSKTR

SEQ ID NO: 14936 - protein, 315 aa, Actinoplanes utahensis
MNVDVRDLELLAALASGGTLLQAAEELYVSQPALSQRLAKIEARVDAQLFERRGRRLVPTEAGRRLTVSAVHVLRELSAAENDVRRIAQFGRSRVRVATQCSTTFGWLTPVIRRHREDHPDSQVRVESVPDDDVVGALLDQRLDVAVLTKLDRRAEELQLTPLFDDEMVAVVAPHHAWARRDHVAPRDFAHVDLILYDSYDPARALATPLPLPPGAHPRSLTTVPMVTDLVVELVAAQEGVSVLPSWVIAPYSERGDVAVVRIGARPTTRTWYAAVRAGDERASVRGFISALKQHFAAQGPGEVLLNAAGGSGHL

SEQ ID NO: 14937 - protein, 275 aa, Actinoplanes utahensis
MGALRRAGPSTTAHVPAERGGGRPGAAASGRGETRRRTGSPSRRRHSGADSMSAVRRMAHAVLAAAVRGRRDRGGDWGEAVLAEFPLVTGDWAAVRWAAGGLRAARYERRARVRELPRMVRIRRRAVLIALIGIVGGLLVNRFVVTVGYEPSGSMQPAYDIGDRYVLDRVAFRLTGVQRGDIVEFTMPGTDRLVIKRVIGLPGDEITCRDGQVWRNGRPLDESYLPADPGWSGTDCTPVTVPADQVYVLGDHRTVSFDSRQYGPISESALAGRVL

SEQ ID NO: 14938 - protein, 79 aa, Actinoplanes utahensis
MRETLHNSTNEDQVKWQPSSTKAHGMTRFNGPVGALTGNKPMFDKVTFTWLAEWLVPIPPTAEARVTVLAGLVGRQSVQ

SEQ ID NO: 14939 - protein, 236 aa, Actinoplanes utahensis
MTGTLRTVALDAADHRGLADFYVALGGWSEQYADDDWIQLRTAEGWRVAVQAAPDHVPPRWPDPRFPQQAHLDLRVPDLAAGAARAVELGATLLRENQTWHTLADPAGHPFDLCLQAGAPATTLMGVMLDCPDASRLAAFYAELLGKPVTYEGEGMAMIGEDGAQPIMFQQVADYRAPRWPDPAHPQQVHIDVTVDDIDRAEAATLKLGATALAASGENWRVYADPAGKPFCLCWD

SEQ ID NO: 14940 - protein, 390 aa, Actinoplanes utahensis
MNERLLRDLVPAVIGVLVRRGADFASAEDAVQEALIRALQTWPADPPRDPQGWLVAAAWRKFVDAVRADASRRGREEAVDAQPPAGPAPGVDDTLRLYFLCAHPSLSQSAAVALTLRAVGGLTTRQIAAAYLVPEATMAQRISRAKKKITGVALDRPGDPGTVLRVLYLVFNEGYSGDVDLAAEAIRLTRQLAGLTADPEVAGLLALMLLHHARRASRTGEGGRLIPLADQDRSLWDTAMIGEGVLILQNALAQDRLGEYQAQAAIAALHADAPRAADTDWVQIVEWYDELVRITDSPVVRLNRAVAVGAADGPRAGLVALQAVGEQVPRYAAVKAYLCERAGDVQAAARLYARAAREAGSVPERDHLTREAARVRQRAGGSPRTPASGW

SEQ ID NO: 14941 - protein, 135 aa, Actinoplanes utahensis
MKYLLLKHYRGGPKPAADCAPMDEWTPQEVDAHIQFMRDFAARLETTGEFVDAQALAPTGAWVRYDGEGRPPVTDGPFAETKDLIAGWMVIDVDSWERAVALAGELSAAPGQGGAPIHEWLEVRPFLAEPPTVTE

SEQ ID NO: 14942 - protein, 69 aa, Actinoplanes utahensis
MSEPETVAGGSTDQHVSGLPETGDFLTDAPPTSGTPADGSSNAGINRTGANRPAAATADAEEMDDLTDR

SEQ ID NO: 14943 - protein, 230 aa, Actinoplanes utahensis
MTTTLDVHGITIAYRRAGDPGNPPMLLLHGLGDSSADWHPVLPDLVETHCVYAVDLRGHGDSAHPGTYSFELMRDDVLGFLDAAGIEKCVLVGHSMGAVVAVLLALRAPQRVTHLVLEDASVPRPGMLRRPPLPPPVEPVPYDVPVVNAIRAQLDQPDPAWFEALATLPVPTLLISGAESPFPHELLADSADRIPDAVLATVTAGHHVHLEQPTAFTTEIARFLTGRVPR

SEQ ID NO: 14944 - protein, 32 aa, Actinoplanes utahensis
MRRYAPGWFSRVFEARSVRGVGGRSVTGGRGR

SEQ ID NO: 14945 - protein, 176 aa, Actinoplanes utahensis
MVYGVTGSGKSTLAARIAARTGLPYHPVDDLAWEPGWVEVPVPLQRQRIATICAGDSWVLDSAYMSWLQVPMARADLIVGLDLPQWRCLARLLRRTLVRLLLRTRVCNGNVESLRELFTRDSIIRQQFSSYPRKRMRMRAWHLDPAMPPVVLLRSPRAVRAWLAALPPGPGPASSG

SEQ ID NO: 14946 - protein, 252 aa, Actinoplanes utahensis
MPVVDAVARCAAPAAGGMVSGMTLVFPGPRLGGLSLIAGPPLLLAGTALRLGVPFFFPHQIAAYQQRPGLWGTSYALALAGIIALWPGIAMLAAQIADSRPGWGRWGGTLVITGLFARVFQHGADTFAFSLTGSAGPVVAEQAVGAYYRYPEWVVSSLSVAIMTGWIVLAVGGRLSRVLRAWQAVALALMSGLMIGVLKGSTVASVVEVAGLAVALVPHGVTCLRGAGLPGWRTLGLVVLTAGASIILGQLG

SEQ ID NO: 14947 - protein, 36 aa, Actinoplanes utahensis
MTAARAPMVDVAAAVAVLAACGVAAQEVGPPAGWPS

SEQ ID NO: 14948 - protein, 440 aa, Actinoplanes utahensis
MADRGRRPLADRLAGPAPPAPRRAARRATLRPRGHRGTAAHRPRRARHGRPQPQHDHHEGECGPARRRDPPRGVRGRPGGDRDGGPGGAAADAPHPRTAARRAGRPARSRRPRRGDDERGRGGVAAPRSARGGVPDRAGVADQRDPARARRGLHGRRRRGAAGGHRPGRRRRRIRAARDARAGHRVRRHAGRRAAARRRVRGDRTHPVRRRDTVTEPIRVLIADDQTLLRDSFRVLLDSTPGFTVTGEAATGRDAARLALAHRPDVVLMDVRMPDLTGIEATELICRQTDDVRVLILTTFDLDEYVYGALRAGASGFLLKDTTAAGLIAAIRVVAAGEALLAPTVTRRLIAAFTAAPPRPAPAVAAHLTAREQQVLLLIARGRSNTEIAGQLRLSVPTVKTHVGRLLTKLAARDRAQLVVAAYESGLVTAAIADSRVSPK

SEQ ID NO: 14949 - protein, 121 aa, Actinoplanes utahensis
MAAKISVVGDTLHVEVLGLHKVWALRSRLEIPLANVAGATIDPGITRGWKGIRTGGTHLPGVLTAGSFHHAGERIFWDVSDPNRAVVIALRDETYARLVVEVDDPRATVDLVENAISRPAR

SEQ ID NO: 14950 - protein, 153 aa, Actinoplanes utahensis
MGRPRAFDETEVVRAAAGLFARRAFDGVSVDDLVAHLGVHRNSLYQVFGSKRGLYLRALRWSLQHEVGPLLRHAGPGSLTDLAADPVLDLLLLAAAERAPQDPEVAAEVAAALADLDTALGGQAATLLGLRLCARINPLGKEAADGRQDQRCR

SEQ ID NO: 14951 - protein, 330 aa, Actinoplanes utahensis
MIGTRNPVGGRHHHAQGPDHPAPRHPGDLHPPAAHRRRHHPPAARPRLPGRLRPGRPLPQRHVHARTHARRPAPAGRPVPLRPTFGRLLIAGLLAGLIAGILAGTFAYFAGEPRVDAAIAIEQQNALAHGEAGGGEELVSRDTQKHVGLFLATGLYGIAMGGFLATAYTLLRRRLHTTSDTRAAIGLAAAALTGIVLVPWLKYPPNPPAVGDPATINQRTTSYLAVLALGLVAIWAGIIAARTQPTEWRRATAALLGFLTVVTIAYTLLPTVNEVPATFPAVLLWKFRLASLGTQTILWTVLGIAFAAQLHRIATSTTPAQPATPQTTTA

SEQ ID NO: 14952 - protein, 174 aa, Actinoplanes utahensis
MTSFPATARRVRDESLDPRRRRVRLRNCLYHFAPYGFHATWHHLATTHRIPGRIEADPSSLVRALDEVEAARALVLPRVVAFAARRRLQKREGRRVPAALHPWDSWGCHDIAYCPDPRKHPAEPLPVVVDRVLDACAAGADRAGGCLVCGREDWDLWRVCRNCGVASGGPGTHY

SEQ ID NO: 14953 - protein, 154 aa, Actinoplanes utahensis
MPRFTGLDDLLSREELGTTAWHLIDQPRITGFADITGDHQWIHTDPARARREGPFGTTIAHGALTLSLCMTFLTEIVQVDNVTFVVNGGFDRVRFHTPVRAGARLRGSIRLLQSRRLPNGARLVLRTTAEIDGEPRPACVADQILALYEAPPAR

SEQ ID NO: 14954 - protein, 28 aa, Actinoplanes utahensis
MKLFTKNVLETALNEVMTEHLGHGPPYW

SEQ ID NO: 14955 - protein, 286 aa, Actinoplanes utahensis
MLAAPMCNAPSMIARTPYDDDRSHFSRRALARLVLSDQASGLSNAAASLAVTRYDEFSGAGGRVSEAAAVASHADRLVITAVIYERERGSSWEDIGRYLDLSGPAAEQRFASAVEHWHSAFDAPYRLDETGRKRIPQLPTAAYDPARSIRNLDLWADVRLGFDDKHAVSGGLQPRDDTEEEAGLPKPKGTEIDGRIQLPHLGAFLDLLSEYALHRPTGKAREVVARAMDNSKDEGRGSWHSYTMDGIFETLDVRLAPHGDMVSVIVAGAHSPALRLQISTLLDAFA

SEQ ID NO: 14956 - protein, 291 aa, Actinoplanes utahensis
MSPFTLPDLTGRIAIVTGANSGVGLATTRALAGAGARVVLAVRDMGKGEAAARTISGSVEVRRLDLADLSSVRSFADSWSGPIDLLINNAGITAPELRRTVDGFELQFGTNHLGPFALTNLLLPQVTGRVVSLASQAERMGRLDLDDPNDERRAYRQSPAYNRSKLANMLFIAELQRRLDAAGSPVRAMAAHPGLVRTDIYTEAGPVSRFIVRTLGQSAEQGALPVLYAAAADLPGNSFTGPSRFAHMIGEPQLINRSARARDEQLAARLWSVSEKLTGVRFPAALVERAV

SEQ ID NO: 14957 - protein, 190 aa, Actinoplanes utahensis
MARWVPGTVERLRTAALTLFDEQGFEKTTVAQITERAGMNRRTFFHHFADKREVVFAGQEHSEELIAAEIRGQDHGTDPLRAAVAGLQAVSDQVYEQFREGAVVLGRVIAASPELQERELVKRAILADRIAAALRDRGTADAAATVAAWTAVAIFFVARNQWNQPDNQHTLAHLIAMSREDFLGATRPTP

SEQ ID NO: 14958 - protein, 501 aa, Actinoplanes utahensis
MRTALPAPASTVQARAARVNARALRAAVGRRGGVRPRVHSVTSADATADGIAIVVQAAVASAVATARSGITSAFPAVVTAGSRYAGTTAVASATSTGGRSGARCGPGWPVASGLLVDSVGGIGGGPFGGAAGGSLPLPPTVRALPAWALDAKIRTRCCTRGTIAGTLHTVTLEPTAKPAVAGGTLRPTSPHHTAAGQAPHTPGGLDLDDVAVFVQVVDCGGFTAAARVLRIPKSSVSRQVKRLEQRLGTQLLHRSTRAVSLTDAGRAFHRRVAAALAEVGDAVTAAVDAREVPRGVIRFTAPPDLGAEVLPALLTSFTAQHPLVRVDIDLLAHTPDLVEAGYDLALRVGRPSQHGLTTDKLQDMSFRLYASPGYLAGPTGIPATVEQLAEHSCILFRAHNGQARWQLHRHPHGDDGVDVTVSGRLTVNDMSFVRRAAVAGAGIALLPRLVGEYAVASGELIPVLPAYETAGFPLYLAYPSARHVPLAVRALRDHLLAAFPT

SEQ ID NO: 14959 - protein, 317 aa, Actinoplanes utahensis
MILVLGATGLVGGAVLHRLAALQAPVRALVRRPTPAVMSLSAAGTIDVVVGDVADEDCLRRAVHGVRQVFLVMANGPQQQHHELAVVRAALDARVEHLVKVSAPYVGPEVPVAIARMHHTIEQAIVAAGARHDMRHTFLRPYAFMQNLLHNAPPIRMAGFFTGTTADTPMNMVDVRDIADVATTALTTTRTHGRALVLTGPRAVSYPDVARHLSALGRPTRYLTMRPPEYAAKLHRAGLPTWTIEHLLEIQAMTLTHPETPTSTVRDVTGHTPRTIEAFLAENLTEFTHPRGLRERLIAVPLRLATRRHTTAAAPIA

SEQ ID NO: 14960 - protein, 420 aa, Actinoplanes utahensis
MSGPGVPAAAGPGAAATPAPTGVEETLRRLMPQVLGSLVRRYGQFDGCEDAVQEAGLAAALQWPVDGVPAHPRGWLMTVAARRLVDEVRSGSARRDRESAVAARAEVQPEEVPDRDDTLLLLFLCCHPALTAASQTALTLRAVGGLTTAEIARAFLVPEATMAARVSRAKQRIRAAGSTFPLPSAPERLPVVLHVLYLIFNEGYTASSGRSLDRADLAGEAIRLARLVHAHLPDDAEVSGLLALMVLTHARRTARTTAAGDLIPLQEQDRSLWDRDLIREGLSLAKAALGGPTLGQYQLQAAIAATHADAAAAGETDWRQIHALYLILERIAPNPMVTLNRAIALAEIDGPRAGLALLAGLDADERLAGHHRLWSVRAHLLEAAGERGAAYDFYRRAAKATASLAERRHLEARAARCRPS

SEQ ID NO: 14961 - protein, 123 aa, Actinoplanes utahensis
MKFLISLYINPAVLEALTDEEKGAIGDGHGRFMETLKESGELITTQALVDPSQAVVVSVRDGQTVVTDGPFAEAKEFLGGFYLVDCADRARAVELAARIPDAAIDGLAVEVRQVMFADGLLEA

SEQ ID NO: 14962 - protein, 143 aa, Actinoplanes utahensis
MEPRRRWPWLLSNAGIMSVTVFVAGLGITALVIMLLIAGGAADAGQAKLQIEALKYGLGFSATAGAVAALLLGSHRQVLAEHHCHGCCGARVEPHRTYTVIARRCRRRSDRGLNSSAGGAASLPRSSFSSRSVRVVFAWAGSA

SEQ ID NO: 14963 - protein, 178 aa, Actinoplanes utahensis
MNTITTTELFSRLGQPARIQQIARYDVFDSTLQAQLDALSARTADLLGTPVSMVSVVLDSSQFIIGQHGVPGWMAEVQGTPAEWALCSHTVLAGEPYCIADGTVDPVHADNPLFAMAPIRSYAGVPLTDDSGHVLGAHCVIDVVPRTFTDADIATLTTGATEAMRLLTEHRTRPHPAG

SEQ ID NO: 14964 - protein, 100 aa, Actinoplanes utahensis
MSITSGDTAPGSYGLQRPTMADAREAMLRVHGHTGRSTWERLLQAAGMSGEESGDDALHRLLTAMAGLDPVSRLCAQALNIRLSSHTHLSAAHTMTRSTA

SEQ ID NO: 14965 - protein, 544 aa, Actinoplanes utahensis
MSTTAAAVPVAPTARGRRSFADLSVNVKILMAVALAALVALLIGVLGLSALGKASGSAQLIYRSNVASVKAIGTVDKTLVQARLDTAFQLIAQKPADTQKYADAFSADQQAFTTALAAYKASRPAGDPALIADLESQWQAYVQIAQTKLLPAGQRDDIVGWETIRTTQVLPLMAQMNKDIAALTGAEDADAARNAGTAQSAYDSSRIVSILLLVAGLALALGLGVFVARSIVRSLNKVKAVCEALAGNDLTRTTGMTSRDETGQMGRALDTAVGALRQAVTTIEGSAVTLAGASEELTAVSTQLQTGAADAAHRATTATTASENVNAGVQSIAAGAEEMSASITEIASNASAAAQVSQNGMAVAERTTNQVAALGAASAEIGDVVRLITSIAEQTNLLALNATIEAARAGELGKGFAVVAGEVKELAQQTAKATEEITHRISNIQNSSTTAATAIGEITDVIRQIGDYTTTIASAVEEQTATTGEMSRSVAEAATSSANVARTMSGVAEVANATAESAKATQQASGDLTRLASDLTTLVSAFRH

SEQ ID NO: 14966 - protein, 101 aa, Actinoplanes utahensis
MPTEPVDHVAGQVGAADASVVKGYLRRRLTRFEHQWEIVREYGYTDFADAEPDLVRWIDDRAWTTGDSPGCFRPGRPDSCRICSTFRTVPGSRSWSGCGHR

SEQ ID NO: 14967 - protein, 350 aa, Actinoplanes utahensis
MTVFGCRTCDATLTVPVSRVALPAHAEQSYGNAQGSLAPALEPGTFAVNPLPSGSPWRRWDDCEPGEAEALGWYAPRFSISAGPAGQVLLTPGDVRGAVIDLALVDDAACCGLGGGEPNLVCETCGTPVGRRVDDCGLPQAVWLDPLTTRTTEDGPGPHPVREWAGLLGQESGIPPCDPDGGWHPMWEAAAGSALAHLLAASGGDPVMIDDHRVAGILRPTLDRLVGPPGTGREGTLVLAGPGLPDPAGDFALIPEHPQTGEPWPVAPPVKPVPLAWEVWRHLAVHRDPKPVGRSVLIPPEALPARLPHRFEPDGRVFLRVLARRPEVRQPRLRAVYARGRPYDYSFCGF

SEQ ID NO: 14968 - protein, 102 aa, Actinoplanes utahensis
MTVFALAQIAIHDRQRYDRYAAAFMPVLTRYHGRLLAADESPRVVEGEWPYEKAILMSFDTREHFEQWSTSPEYREISRDREAATHGVVLLLDGIPAVGPVA

SEQ ID NO: 14969 - protein, 200 aa, Actinoplanes utahensis
MLSIEEGPIRPDPETETPDSTTTVIQDRPASLHVTGHYDGARHGDTYVFVQWQRTDGTWVTVQSWGPRDSGTVRSIAQHLTGGARIPAVPTPFSLPFAPPGLILQYLGADQMCLATPDKAARERNPTGLCVTMQQGAFDPDGATDTWKVNGRRVAYLPDAASLIIEWGGDTQIEVGWDPQDIPLTHDQVVELSEGLYPTR

SEQ ID NO: 14970 - protein, 170 aa, Actinoplanes utahensis
MDSGFEEYVRARGDALRRFAYVLCGDRHHGEDLVQEVLVKAYRRWSRIETDQPDRYLRTALVRTHISWLRRLSNTERPAEIADDRAATGAGAEFADRQALRDDMWARLAELTRTQRAVLVLRYYEDLDDQQIAEIVRCAPGTVRVHASRGLAKLRTDLDPAHPTTAGAKP

SEQ ID NO: 14971 - protein, 332 aa, Actinoplanes utahensis
MPEFRRGVELARDFYREAVRPLLDDRPHLAARIGPGSDVLGFDTARSTDHDWGPRLQLFLDDPGDLDQRLREGLPKRFRGWPTHFVPPGARVRSMADTDGPVDHYIDILPLETWLRHRLGADPQWLSLPWQRLAEVAGGAVFHDPGGELAAVRATWKWYPDDLLRHVLGCQWARIGQEEAFVGRTAEIGDDPGSRMVTARLARDVARLLLLQQRRWPPYQKWLSAACPDPRLAAALAADDAKTRSDALADAYEEAARRQNALGLCPPLDTRRRPYFDRGYPVIDAGRFAEALLDGRPAIGSIDQICDSTGVLERPDICRAVCSAAHSPRQEG

SEQ ID NO: 14972 - protein, 327 aa, Actinoplanes utahensis
MTALTHSTANEVTGGVWRIPHQGGTAVRKLVMRRRAGAAAHLAASDDPGHFNYWRREPTAYAEGLARTAFTAGGLSVPEVYRITELADGSVEMLLADVPGRPMQAWRPDDLGELAYRLGVAQCRRLAEIPAYDWLARDFLRDYTLAQPVPEELDWDHPVVRAAWDPELRARLREMCAARQDLLAAADRLPRTLCHHDVWPMNVVLAASGPVLLDWAFVGPGAIGEDAANLALDTFFDGLIDLSLLDGVLEAVTDGYVRGMTEVDPLVVQRAIMITGAAKYFWLAPRMIDMLMRDQSAAYDRRDWPERFAGRAPILEVVARWAGEALR

SEQ ID NO: 14973 - protein, 230 aa, Actinoplanes utahensis
MSYDDFAEAYASETEGSLENAYYARPAILDLAADVTGRRILDVGCGAGPLLEALRDRGADVTGIEPSAGMLHLARRRLGAGVALHRLGLGGDPLPFPDATFDDVVACLVLHYLEDWTGPLADLRRILKPGGRLIVAVNHPFLYKLIKPEGDYFAVEEWSDEFMFSGRTTVLTFWHRPLHAMFTAFLAAGFRVAVVSEPAPAPGAREAFPDLITSPSGRFMGFLFLVLDAA

SEQ ID NO: 14974 - protein, 240 aa, Actinoplanes utahensis
MFLAYRSSKGHALIDRQLYLPVAWTDDRDRCQAAGIPDEVEFATRVQIARTMLGRTFAAGIRAGWVSMDEAYGQSNSLRVWLESHDQPYVVATRRNDDMITTSMDTARADELIATLPGRAWSRISAGLGAHGPREYDWARAPVRICWRPGRGHWLLARRHRTTRRTGLLRLLRTAEDRPMDLARSAGGRWAIGPICSRRRTRPIHGRPCSRKRPIMPLGGPAGSHRTDRNAPGERVERGP

SEQ ID NO: 14975 - protein, 239 aa, Actinoplanes utahensis
MAHEGTAAWWGRHSVNPAAVLPASRHHGRVLTLEAPLVTKRLRLRPFRSQDADALYDLRSCPEVLRYLYWPPASVEGVREVVAARLAMTKLAADGDCLVLAVEVAATGSFIGEVDLSLVSTEHRHGEIGVILHPSAQGHGYATEAVGALLNLAFDVLKLHRVTAQTSAGNQAAAGAMLRLGMRQEGHLRQCVRFAGEWYDELIFAILAEEWANRTGSAPSHTEGGHGFIGHHGFHNGHP

SEQ ID NO: 14976 - protein, 573 aa, Actinoplanes utahensis
MKSVLGARIRLTRRCLAAAVAVSVLLVPARAAQATETAATLSPFAADVTLTRVTPDTTSLIRAVENAGVTKGSISDVLATGRTGTPGLCHTPNGLNGALIPDGFCWDKTDDESTYGEGGGGWMPQGFTTADGAYVGRSLTITSWYHGTYVRDREPPAIEDYARISIAESTPTRVRYGHVALVEPAAGGTFKPLTFRTHADGIAWYGDRLFVANGAELQIYDLTHLWRMTDTAGDGTGLTAGRSSARGHLWALPLVARYSTVGTAQVDTESSAFDKDNPRACGPAVANYLCLSSLSLDRAGVTPALVSAENRTKPGGRVVRWPLTALGAGTPSTVASEPEGYISPVGGIQGTATDGTSYYMSGTCPLSYPSADTLYACIFVAAPGETPRVLTQAPRLTEGLSWDPRAKRLWGTNEAVPSAGHALRVVFSLNPGAGAAVDGWGWLTNYHMAGSACATPEGNDTGLGTKIAVWTCTGSDLQRWRYDNGLIVHKVSGLCLTPAGNGADAQGTVLTLWTCDGASDVQRFSAGPDGSLVNPWGKGLTPSGNDVEKGRYLTLWTKGTPTPDVQDWVIKGF

SEQ ID NO: 14977 - protein, 274 aa, Actinoplanes utahensis
MRAAPGRGSAWLPSMCAAVPGGYYDVLIAGLAATALVTAFWAYAVVAHVRHTRTVPWPLLLTPLLFAAVWLLASGDLLRRQGPRDGQGRRAGLVPRHPPPARRRRRVLRADRRRLVRVCDPARAVTGSRPRCPAVGPAAERVGRPHRGMRRFFFPGERAGLTKRPSRLTGFRALLAGGTLLTVLTLILQPATEVRGCSNYGGNGNGTAFADEGWDLTYHVLLLVWLLTVITEQLLPITWNGRMAGPVIARGVLAVTLTLIACCGIGLKLLILCH

SEQ ID NO: 14978 - protein, 179 aa, Actinoplanes utahensis
MRDWSYYGAAHRYAVHEDEGADRLCDRTMGALRLAGDEAELRRRAGAGDRCAAVTLFEILVDADRLDDLRAMQEAGDDRAGVTLMEALTRQGREDELRREIAAGHDVMWLVHHLNDRGRMDDALAALQEWADQHPDQARLAHARRLTVLLEHGRVEEVRRAAESGDHTAARYLGRFFSK

SEQ ID NO: 14979 - protein, 111 aa, Actinoplanes utahensis
MRARDNVADASELQKHLTGDTLTVATTMLGLLADPTRLRLLAALVPTDQDVSALTTTTGAARPAVSQHLAKLRLAGLVRVRREGRRQVYALAGPHIATLITEVLHAAARHR

SEQ ID NO: 14980 - protein, 332 aa, Actinoplanes utahensis
MTTWHGIRHRLTPHSHAAADRVDDALESSRVGMRALWISLGVLGLTAFAQAVIVWRSGSAALLGDTLHNAADALTAVPLGIAFWLGRRAATRAYTYGFGRAEDLAGIVIVLVVATSAAFSGIVAVRRLADPHSLTHLPWVVAAGLAGFAGNELVARYRIAVGRRIGSAALVADGLHARADGFASLAVVLAAGGAWRGWAWADPAAGLLITVAIGLVLRDAAREVYRRLMDRVDPHLVDAAERELRRIPGVRGVSGIRMRWIGHRLYAEASVLVDAHVSLMAAHEIAADAEHRLTHQVPRLTEASVHVDPDTPPGAAHHLRLSHAAPPATFGS

SEQ ID NO: 14981 - protein, 193 aa, Actinoplanes utahensis
MIDIAVAGPEHRTRIVSALVAAFRGDPVIRWQFPDDDSYPELAAVFFGHLFDKRVHRGAVWVAEGGNAVAIWEPPADASPAVEDVLPRKLPADVLARVRAYDDAVHAALPAEPYWYLGVLGTHPDHSGRRLGHAVMAEGLRAAAADGRPAVLETATEGNVRMYERAGWRVIAELTDPLPVWVLQNDTYGSSRM

SEQ ID NO: 14982 - protein, 381 aa, Actinoplanes utahensis
MRILLPAVALLLVAACGTTTTPTSAPAGVNPHAGHLAGSAPPSQPLRAGERFVDLALPQAYTPKAPNGGTDEYRCFLVDPGLTGNAYLTGSRFLPQNAAIVHHAIFYRLDPQQATEAARIDAQTPGEGWTCFGDSGVEGQTAWVAHWAPGAGETQMPAGFGFAMPPGGKLVMQVHYNLLEPGAAGQSDQSGIRLRVAAGATPLKPLSTDLFPAPIELPCAAGESGPLCDRAAAIADVGSRFGADAGEQEGHLVERCDAGKVTPGTTQHCDRPIEEPATVYLAAGHMHLLGRSITIELNPGRPGARTILDVPQYNFDNQALVTLPKPIPVKRGDVVRVTCSHDAKLRRLLPQLHTVAPRYVVWGEGTSDEMCLGILVTGPAS

SEQ ID NO: 14983 - protein, 77 aa, Actinoplanes utahensis
MTIVPRMKTTRPRLMGTTEICVRLGDLSRQRVNQLSAKTNFPKPIADLAQGRVWLADEIEEWIARHRTTPMPPHHDA

SEQ ID NO: 14984 - protein, 401 aa, Actinoplanes utahensis
MVPVSGMGGAMLPGDVLRLGVVGLRTRKLRAALSALGIAIGIATMLVVTGIPASSRQAVADRLAALGTNLLRVQPESAGDRPVPLPPESVAMAARIGPVTAVSAVANVHAVVRRSDLVDPYDGSGLTVLAARTDLLTAVNARIRSGRFLTTATSRFPTVVLGAEAAARLGLGEIRPDGPAPQVSVGNRRFAVTGILAPVPLAPDLDQSVLVGWAVAGRLLGFDGHPTVLYVRCREAAIEQVRAVLPATVSPQLPGLVRVSRPSDALSAKRAADSAFGALLLGLAGVSLLVGGVGVANTMVISVLERRREIGLRRALGAPRGHIRLQFLTESVLLAGLGGGAGTAIGVAATIGYATWQRWPPVIPPGSVAAGLGGALLAGVVAGVYPAMRAARLTPTSALAA

SEQ ID NO: 14985 - protein, 268 aa, Actinoplanes utahensis
MTAPVLSLREISRIYPGGVTALDRVSLDLAPGELAAIVGPSGSGKSTLLHIMGTLDLPTSGTVAIEGRDVTTLGDRRLAGLRGRRIGFVFQQFHLIDGISAAENVATGLLHAGVPARRRRSLAEEALDRVGLGHRRGHRPGQLSGGEKQRVAIARAVVNAPALVLADEPTGALDSANGEAVLELLGRLNAEGATIAVITHDREIAARLPRRITIRDGRLEDTGSGEAGFGAARTDGAVLRGARIDGAGLREARIDGAGLRDGRGDAAG

SEQ ID NO: 14986 - protein, 294 aa, Actinoplanes utahensis
MDLTDERTVPGTLGFGPARVVKGPGTGVITHLPETGRKTIRGRELYRVDDQPVIVIYGDTPLFRPLNKPGLSGRDVLEVRQNLTALGYPARSLHPEVADAGLLAAIKRWRGEDDLPGSGIAPGGVVVLPGPSRVSEVRAQAGDPAEGPVLAVTATGAVVSVPMSPADVATVRTGTAVTVIAPSGTAAPAKVTAIGRAVTGGEGGEAAKVDVTVTPDTPISAYDAAAVQVRITTLVRKGVLAVPVGALVALAEGGYALQRPDGSLIAAATGVFSGGLVQVSGPGITDGLTVVSTP

SEQ ID NO: 14987 - protein, 183 aa, Actinoplanes utahensis
MPKILYLTALLALGACSAPAPDPTAADGGGRVATLQSAPPAAATSAPAASRPQLRLDTSEEEANRFWTAYDDCLVAHGVKADPVDQPGPAGPGRRLDQSGEPRSAYTACAGRLPRQPPELDEDANPKYAAQWNDHVKCLRAHGLKVHVTKPGEWTYDSSDGGIPANESQIEHDCLLEAFGHGS

SEQ ID NO: 14988 - protein, 228 aa, Actinoplanes utahensis
MCAYVLVAEDDPKQAELVRRYLEHEGHAVVVVGDGRAALEEIRQNPPDLVVLDVMMPRVDGLDVCRILRRDSELPVLMLTARTTEDDLLLGLDLGADDYMTKPYSPRELAARVRTLLRRNRPAARVADPVLRVGNLQVDPVRHEVRADGRPVTCTPGEFHLLRTLAAEPGRVFTRETLLRHLHGFDSYVTARTVDVHVMNLRRKIEPDPRRPARLLTVYGVGYKLADG

SEQ ID NO: 14989 - protein, 618 aa, Actinoplanes utahensis
MARARSAGRGSLLGRLLVLSAVVSLLSIGATAWLAVRTTTRAIQREQGQALTDDAKIYDTLLGYAATHRDWSAVAPVVAQLAGSTGHRVVLTGQAREPIADSASGPLPQQPLTTVDPTDAGNRIDPRAVGPFRLTTAERAGLRQIAARVQSCLREPSTPAPARDGQQRVLPHNVEIVDEPSGRPRLETPGSDLSADTVTCMEGRTALAAPTATEATALQQLDRLVNSCLARQHLPAVTIGLENTWTWADAESARSGRRRNQPVADCLTAGRREQLAGWVAPAALLFVTAPGEQSARRASTLDLSRPNQIRIGAVTGLVLLAAIGVTALVGVRLVRPLRALTAAAGRMRDGDATARVRVTGRDEIARLATAFNDMADRRRHVEQLRHAMVGDIAHEMRTPVTNIRGWLEAAADGVVPLDRELMASLLEEAMLLQHVIDDLQDLSAADAGELRLHPQLVEVAELLPAITDAFTAAADRAGVTLHTTAASALVTVDPIRIRQAVGNLITNAIRHTPSGGRIDIISGTSAGRLRIDVTDTGPGIPPEQQALVFERFWRADKSRSRQTGGSGLGLSIVRKLAEAHAGTVTVTSPPGQGATFRIDLPVAGPPGSQRAGRGSMGR

SEQ ID NO: 14990 - protein, 344 aa, Actinoplanes utahensis
MSGPGQRIASTTSPGGARIGYATVGSGPPLVFVTGWLSHLELSWALPAERGFFQALADGRRLIRYDKPGCGLSTAAGDGPHTMEREVDALRAVVDATGLERFDLVGISTGAAVAAAWAAREPRSVSRLVLYGGWPYGPDVASPEIRTHVLGLIREHWGLASDLLGGVFAPDADPGTRAAFVRYQREAATAEVAGAMLLMAYRIDVLDLLPSISAPTLVVHRERDRAAPIEQGRRLADGIPGARLEVVPGRSHLPYIGDYRPITRAIRQFLGLPAAHRGAAPGLTERQREVAALIAQGRTNREIGERLGITERSAEAHVERIRTRMDFRSRAQIAAWYVATAGPA

SEQ ID NO: 14991 - protein, 259 aa, Actinoplanes utahensis
MGDRYPGDAELVPAEARKRPVGDHVTKANLADIVVDDHLQRIAAGDLRPGDKLPTEIEMCDAYGMSRSAIREAVHKLAGKGFVSVRQGSGSTIAPREQWNELDPDYLRCGVDTDMFHELVVTHLIEARESLEPVIAGLAAQRATEEERRTLRALLAEQQRFGDREPEAQAEADIRFHSALAYATHNPLLIAMHTSLVTLGRRSRTLATQVPGGVDRAIMWHTHLLEAVESRDSMAATDAMRMHLRQVRGELQAAAQLER

SEQ ID NO: 14992 - protein, 71 aa, Actinoplanes utahensis
MTRPAAIPASGSMAYSYFTVHQLHGPLPLRNGGDTPALFCWSFLVIAAGAGSWSIDAWLYHRWADMAPLRN

SEQ ID NO: 14993 - protein, 272 aa, Actinoplanes utahensis
MVNSIQRYPEMQDQVAVVTGAASGIGAAVARDFAAQGCHVALLDADRPALFRLVDALADEVEGALRPIEVDVSDPDAVRSAVGDLTAGWGAISYLVNCTAGLVAAGAHAANEQWDRALAVNVRSAAMLLGECVPHMMPGSAAVHTASIAAREAQPLRWIHDAAKGAIFAMTRCQAFDLAPRGIRVNLVSPGWMGAPEGVRPVPGDGDAGESAWGVHRILPRAGQPCDVARAVLFLCSEDASFISGTEMMVDGGYSVLSAASLRETSRVAGAV

SEQ ID NO: 14994 - protein, 257 aa, Actinoplanes utahensis
MPRYEVTTLAVGHSEIPGPELFWMRDWDRWHPLTFQVVLIRGEGIVALVNTGPALDLEPMNRGWAAFLGERAAMRRAEGEFLPDQLARVGVTAEEVTHVILTPLQLYSVSNVLAFNNAAICISERGWSHFHRTHDHPHDDRATSLPDDILVPLVTTAWPRVRLLADEDHIAPGLRTWWAGAHHRASMVVEVDTANGVVAISDAFFHLENVEQNHPIGITENIYEALTAYERVRRTADIILPLYDPKNFTRFPAGRVA

SEQ ID NO: 14995 - protein, 252 aa, Actinoplanes utahensis
MVVRRKRSQMVVDECIHRIATGEWKEGAVLPTEAELCKLFGFGRSAVREALQALAAKGFVTLRQGSRSTVAPRSDWNQLDAEYLAMRHDGDLLRYLAEAREVVEPAIAALAADRASPAELRRLGELAGESAQLNGADPSRHAEADMAFHEALAHATGNPILVSIHASITGLGRRSGMRTAVMPGAVDRAFAWHRHVVDTVAGGDSPAAADATCTYVRQIGAEPGPTGRVDRIGFAADVPRQISGGAACPGTR

SEQ ID NO: 14996 - protein, 746 aa, Actinoplanes utahensis
MGKAPSDAQFITSLSRRLGAVLAVTTAALTVNPYAAGAAPGDVSATKSGTVAETGSSSDVAAGQRINWVIGLHNGTNAAVPAQVTDPVEAGQAFVPGSLRAPTGYTTAFSADGSAYASEQPATVKSVRVAGAVLPAGTNGSEAPVKPAGKGFVGNSGGGDGTYAAFFGSNVYTVHHHRAPGAKLMECHDKATGAVCPGYETSTTFFSSEAGKAINTGADDYYTALSPGTVVDQSSGRLYFPAQRGAADGNHNTVGVACVDLVSNRSCGFTVLAGDAMPRVRGGIDLSGAALVRGRLYLRNETGKLFCFDSVKGTGCAGFPVTVDAAAAANTDTTEGARAQTDAFDDRYVFTSFHIAGRIDLVCFDTTTNAVCPGFPKSEPAAGDASKFFVPMLDHGGAVTGACWTLSANHRLVGWRCYSIQGEQVATPTGFPAAGTSVLGYDGLGSPERLGARIYLPMVHSDDTSTYMCYDFATGGPCAGVAALNTGLATRTYSLREDPAAPGCLWSVGDSGRFEVFDAAGHTGCNVAIASVPAIVPASYYCDNKTGHVKGWATLALTGIEPSRYASAVVTLRDATNQPVAGFDRIALKGQELDLSSIPATGATARLTADVVLTAPTGDAVEAGKAAVTLAFRGDDPQVCLSTKVDTACASDGVTAVINEANLLVGTRRSTARASLRYARVGACKPDGPDASTPVAAPATPSGGGSGLPLTGSPVMLVGIVGAVLILGGGVTMMLMRRRRNVRFDA

SEQ ID NO: 14997 - protein, 219 aa, Actinoplanes utahensis
MRGISRVVVEIRRTKGREVGRPKDPQRRQDVADAARRAVVRDGLTQVRLRSIADEAGLTAGAVLYYYGNVDALLIEVYHQGVERWCVEREALVRRHDDARLRLRECIETGVADGPDDELGRLLMEFTPRVLHDPTAARLDGEFAQRQADIYAEVLNRGVDQGHFRLSDAAELLAATFVAIEDGRQLDVLSGRISRQESVRTLVSYARAVTSCHIPDTVG

SEQ ID NO: 14998 - protein, 148 aa, Actinoplanes utahensis
MNRATRRVLAIATGAAAVVGAVPPGSAAAADIQVSYIATIRVDSGHGAEYFQARLTDPADVRAATDNMQGVTNQHINGRVVYTGADVNKGYTWHLDPADVSFVDQSMELCDGAPSYVAGDPNSYTRYCPWHSKVQDLRVTYTPYRPRG

SEQ ID NO: 14999 - protein, 221 aa, Actinoplanes utahensis
MRTTKIAVSVATVLAGLAGTVSPAAAEPAEPALAVSDLTVLGGGTRDARGNTVGRDVCGPRGTVLPRHALGDGSSAYYAHGDALGAGLDPDRAVTTDLWCTFSLTVTAAQGRAYNLTNLWMAGQSRLAAGTSGTATTSVSSPSGHTNLTTTISGPTTLGENWQLNGLPSDRALIGGCGTAETLVVTQRMHLPRESNGYLSNVADPGWNSTRLMLSSVPCND

SEQ ID NO: 15000 - protein, 166 aa, Actinoplanes utahensis
MPVVEAVIVVPVTPDVAFAVSQTAAPLRYRWDPFVREQHFIDGATDPGKGVRTFTRSRHGIVMISEYVSFAPPSHVGMKMVRGPWFFDVFAGGWRFAPAPDLPDHTVATWRYHFRCRPAILRPVAERIGTWLLGHDIRRRIEGYARGCEDPEVLAAVRQSLDDHAV

SEQ ID NO: 15001 - protein, 224 aa, Actinoplanes utahensis
MRRHSGARTRPTGVAARRSPPRPCETMGGMPYHVHREPVPPEKGRTGAWTRFGISAAWGVVMLAFFATSVLASMIGVGLLLETPPLTGLAGFHTDELVEAAGVTSGIAAVMACRRARMWWLRARLRRLRRHGVCATAKVTNRELVQTVNPRGPDVCQYTISVHWHEATAEHGGQRRYRFFGSARDDFLKRTASGAAVTVYHPPGRPRRFLIDIPYAPTVADFFL

SEQ ID NO: 15002 - protein, 38 aa, Actinoplanes utahensis
MAQVAATTADGAKATQQAATDLTVLAGELTATVNSFRH

SEQ ID NO: 15003 - protein, 547 aa, Actinoplanes utahensis
MPNGLTVKPPRAVDVLSGDTQPGRQAGSWRSACPARLGVTVCGVVLVSYCWLLMAQPMSGRAMMIMSNLMMIGAAVTATTVAALGFRRLTTSSRRGAALLIGSMVSFAIGQTMYFSYELHPEHGQPFPAPADVAYVCSSLLLVAAIAILAPRQRRRLQTALDAAMIGCALLYVSWALVLGPIVRGGAGSAMEWTLLLLYPIVDLITGSIALLVVAQAGTQYRGPRLTIGLGALALAVGDSGFAYLAHLGLYVSGESVTDAGWVIGYLAMGWGVWYLAAMQERPAGQARARSVASDAGAATVPTRATVVGVTTPYLPFAAALVTTVFLVARDGSVPKELLLLGLGFALLVMVRQVVALWDNILLAGKLRSTVERLQLREQELEMLAFHDSLTGLANRTLFHDRARHALIRQDRLKTSLSVLYIDLDGFKAVNDRLGHAAGDALLVTVAERLRSCVRASDTLARLGGDEFAVLADPMQAVEDVAVIAERIVRCLAAPVSLSNGTAMVTASVGIATREPFSGDLDALLRRADEAMYQAKGGGKNQVVQAR

SEQ ID NO: 15004 - protein, 482 aa, Actinoplanes utahensis
MGRAQGPAWAWFAGIGLLVVMAYPLLPGDGLPRCYFDGIGVGGTVAVILGILRNRPRAAGSWWLLAAGQLGTVAGDIMYDYRQAVLHNASWPGPPEALYLTSDLAVAAGLFGLLRRRRRSSDHAAFVDSAIIASAFALLSWIFLIKPAARDASLGRWAQAMMVAFPTVDLLLLAMVACLLTVNGARNTAFFLIISRIAVTLVGDYTWLIADRTSYDPGEVASRLVDIGFLIAYVTLGAAALHPNMVEVGQPTTAPRRPTSAIRLVFLAAAVLIAPVLLAWQARTASGYVPDANAIASGSAGLFLLVVIRMALLLQQVRAQNHLVERQAQRLRELAERDVLTGLPNRRAWDEALPAALNRAARDGSPVTVAILDVDHFKAFNDTYGHPAGDRLLREAAASWRANLREADLIARYGGEEFVALLPGTPLGEATITVDRLRPTTPMGCTFSAGVATWDGHESAAELVSRADRALYRAKHAGRDRV

SEQ ID NO: 15005 - protein, 538 aa, Actinoplanes utahensis
MLGVLRRLRLRSRLFLAFGLFCLLVAVMTSVGVVESRRQTHVADEVGRLQVLTRDVMQLKFLNADASAWQLGFGWDSSLIGGKAAADPESSNRKGTLEAYELVKRQIAKIEGADLAAGERDSLNAVKKHFADFLSFDNQIVAIMRTGGRSAPQRTADLMNGPAYETFQAVGENIDKLADSVIARSDAAQRETQAAAQRLRTALLIGCGLALVLTVLLGLLLTASIVQPAARVARALRVLAGRDVTPRLPTDGRDELTDMAQAFNEAGDAMRQILSGVGERASSLAAASRGLADVAQRMDTQAFDTSSQATVVAGAADEVSGNVQTMAGAAQEMVSAISEISRSTTSAAGVAAEAVTSAQQTAESVAQLVTASAEIGAIVATITSVAEQTNLLALNATIESARAGDAGKGFAVVASEVKDLAQETARASDDIIAKINAIQRTTEHATAAIGRITDVVMQIAELQENIAAAVEEQSATTDEINRSVSEVALGSQHIADNVASVADIAAATTRDATSTREAARELGDLATDLDTLVASFRY

SEQ ID NO: 15006 - protein, 271 aa, Actinoplanes utahensis
MNVVQRYPEMRDQVAVVTGAASGIGAAIAQDFAAQGCRVALLDINETQLHRTAADIAAGAPGTVRPITVDIADSTAVKESLAELVAGWGGISYLASCAVSFVAAGVDATQEQWDRVLQVNVRGTAMVLAACVPYMLPGSAAVNTASISAHVAQPDRWTYNATKGAIVSMTRCQALDLAPRGIRVNVVSPGWIWTPEVLRAAQDDREAWEPVWGPYHILRRLGEPHEVARAVLFLCSDDASFITGTELMVDGGYSALSAEGLGQTSQFAGTA

SEQ ID NO: 15007 - protein, 271 aa, Actinoplanes utahensis
MVLCSAYWRQVGTRSYRQESDVAKVNLADIVVDDHLRRIAVGELRPGDRLPTEPEMCDAYGMSRSAVREAMHKLAGKGFVTVRQGSGTTIGPREQWNELDPDFVRCGSDTDMLRELVEVHLIEARQALEPVTASLAAIRASEDQRRELRALLVEQEWLGDRDADAQAEADIRFHSALARATHNPLIIAMHASLVTLGRRSRTLAAQTPGGVDRAIAWHTHLVEAVEARDALAATDAMRMHLRQVRGDLQAGGPVDAQGAASGFHPQVSSCS

SEQ ID NO: 15008 - protein, 423 aa, Actinoplanes utahensis
MGRGASSRVGGRGGGHREWCGGDLRRVLPSGERGTGPSDRNHREHLRGARRPRACAAYGCHRASVVRPQELCTLPGWTGGMKALIFQGPMRMVVEDVPEPVAAAGELLLRVDAVGICGSDVHGYAGETGRRTAGMVMGHEISATVLELGDGVTGWSSGDCVAVNPVIGCRQCIRCHAGNTNLCPYRRVIGVDSHYRGGYAEQIVVPAANAVPLEAGLWQGALIEPLAVGLQAVRQAGVCRDTEVAVLGAGMIGLAATWAAWRDGARDVFTGDLDATKVRRAERLGAVGLSLSATTLREALEARGVTEIARVVDAIGISATIDSALDMVTPGGTVCIVGMGSPQVQLPAYALTTAERRIVGSFCYSEAHFREAAEALLDGTVPVDLFIDREIGLDEAPEAFRQLASGERATVKTVIRPTGRQAC

SEQ ID NO: 15009 - protein, 248 aa, Actinoplanes utahensis
MVRRKRSEVLVDDYLRRIAARELVEGDTLPTESELCRLYGVGRSAVREALQALAAKGFVKVRQGSGCTVAPRVEWNQLDPAYLRVSHNGDLLSHLVEAREILEPAIAAIAAYRASPVHVQRLRELAEELEQVGGADPGRHAAVDMAFHEALARATGNPVLVSIHASIAGLGRRSRVATAAVPGAVERAVFWHRHVVDAVAGGDPDAVRDAMRMHMRQVRTEIHRVGAAMPDQVPSSGKVKGAQCPPTR

SEQ ID NO: 15010 - protein, 346 aa, Actinoplanes utahensis
MSIRTIPRFLLTALAVTTMVSATACQKSPSAKSGSTTSSGPVKVVYIPKNLGNPYFDAIVAGFKETSQTLGYQFEEAGPASPDPTAQIPFIDAAIQKKVSAIAISPNDDEALLPSLEKAKAAGVKVITINSDMKATDGRDAAIMPTDFSPMGKFLLDLAAQQMNYTGKFAILSATSTAPDQNAWIEGLKKELKNDPQYAKMQLVDTVYGDDQVDKSTTQARALLTKHPDLAAIISPTAVGLPAAAKVISESPQKGTLVLTGLGLPSSMKAYIQDGTVKKFGLWDPKREGVIAGYLLAGMARGTITAQPGATFSAGSLGTMSITPAGQVISGPLVTFDGSNISQFNF

SEQ ID NO: 15011 - protein, 358 aa, Actinoplanes utahensis
MTSETISPSVTADAGEPLTASTETWRQRLLHAPESTAAALLVAALLVGVLMSADFWDPAALLTNTSSYVEMGLVALPMTLIVINGDIDLSVASMVTLSAATLAKTYQAGVPTWLACVLAVLAGALLGAVNGVIITYFGLPSLVVTLGTLALYQGMAEVVLTDKSIGDFPEAFVGFDQYGVFGTMPDLPMPVLVLLVAAAAFWFLLHRTVYGRLCYLIGSNAEAARYSGIRTAMVRTVAFTLSGTVCGLAAILLTSRLGSAQSNFATGMELLVITVVVLGGTDIFGGRGSMLATLLAFFAIVVVRQAMTVASVNGEMQNAVIGLLLIGSILVPTMTASLAARLRHHTRRRPSSVGRRRS

SEQ ID NO: 15012 - protein, 334 aa, Actinoplanes utahensis
MKFSMPRGRGLYLFRDLGIGVFVLALTAVFGGLQGRFLSPTNVNQILLDIGIITIVAVGQMLVIVTRNIDLSVGSIVGLSAMAMAMLVRDHPGVSVPMAVLVAVLVGAAAGLCNGLVVSVGRVPAIIATLGTLAAFRGVIFLISGGRQVNDWDLPRGVVSLASGAHTAVPWLLVSAAATLVFGIFLTRYTLTGRRFYAVGSSPEAAVARGLPVKRLTVGVFVISGALAGLGGAMYVARFASINPADAGLHMEFAVISAVVIGGTNIFGGSGSILGSLLGCLLIGILGNGLTVVGVSPFWQSAAQGAIILAAVIFDARIRMNYEKRRRLSGRALA

SEQ ID NO: 15013 - protein, 501 aa, Actinoplanes utahensis
MEAALACRGLSKSYGGARALTDVTFVVEPGEIHVLLGENGAGKSTLVKIAAGVVASDTGTVDVGGVSLPPGNVQAAQAAGVNIIHQEPRLFGDLDVVGNIYLDRPPRRWGTIDWAAAIRETQKLLDRVGCRVSPRAKVRDLSVADQQMVDIAAALRRDPKVLIVDEPTASLTPAEVARLFSNLRGLRDRGVAIVFIGHRLEEIMEIADRITVLRDGELVTVVRAAETDADALVRAMAGRAVEEAAAPAARPTGDVLLRVRDLASAGAFREVSFDVRAGEVVGLAGLVGAGRTEIAEAIFGVRSREGGTVEVGTSRSRPRNAAQAVRAGLVYVPEDRARHGLAVRCSIRENATVGLLSSLARHGVRRGRRERETAAGAIRQYAVRAASTEQPVSSLSGGNQQKIAVAKWLLTGPQVVIVDEPTRGVDVGAKAAIHRIVLDLADRGIAIVVISSETKELRLLADRILVVREGRLAGELGRADATDERIVALATRNVDVAGAST

SEQ ID NO: 15014 - protein, 311 aa, Actinoplanes utahensis
MADGPHIVITDCDLGDTDIEEELLISGLDARVTVARCKSEDDVIDAAGDADALLVQWAPITARVLEALPHLRAISRYGIGLDMIDLDAARTRGIEVANVPHYCTEEVASHAAALLLALWRRLPALDRSVRAGRWEPVPVMAGVKPLSSATLGLLGAGRIAQLTARPFTALGTRVVAYDPYATATPGVIELVGLDELADADLISLHAPLNAETRHLVDAAFLSRLKSHAVLVNTARGALVDTAALIDALRGERIAGAGLDVYETEPLPAHHELTSLERVLITPHAAWCSTDALPTLQRQAAENLLRLLAPSA

SEQ ID NO: 15015 - protein, 282 aa, Actinoplanes utahensis
MRIALLDTASGPRLAAECDGAYLPMAGNDLRAMLTADADLTDPVLGSPPVTGSLRAPLRPGKIVAIGLNYLDHIRETGLDKPVEPLIFTKFVSSVVGPTDDIVVDPALTERVDWEVELAAVIGRRARNVDVTQALSHVAGYLVANDISARDLQFRDGQWVRGKSLDTFCPLGPVFVTADEIPDPQRLSLRTIVNGEIVQDSSTEEMIFSVAELVAFCSRSFTLDPGDVILTGTPWGCGEFMNPKRSLREGDVVEVSVDGIGRLRNTVRHASWSLSRRTEPCE

SEQ ID NO: 15016 - protein, 526 aa, Actinoplanes utahensis
MCCRGNHGRSLSGRCRQFLPGPHRRRPQPAPQRSPDDPLCRDPGGRAVSGLGIPGTARGVPFPTAAARALADEQLRANLRRATSTIRRRRDEAVGEIAGWEQLRDAAAAIKAETMARLPELLERFEAAATAAGAQVHWARDAVEAGAIVARLVAAAGASEVVKVKSMATQEIALNHTLARSGVDVVETDLAELIVQLADDVPSHILVPAIHYNRKQIRDLFRDRMPDAPADLSDDPHALAAAARAHLRARFLSAQVAVSGANFAIAESGTLVVVESEGNGRMCLTLPRTLISVVGIEKIIPRFTDLSIFLRLLPRSSTGERMNPYTSTWTGVTPDDGPQQLHIVLLDNGRSATLADPVGRQALHCIRCSACLNVCPVYERTGGHAYGSVYPGPIGAVLTPQLTGVAANPSLPFASTLCGACYDVCPVKIDIPRVLVHLRQQAVLASPAAPEGAVMRALTWTMSDRRRYERALRAARAGAAPLVRILGRRTVRRLPAPLSPWTRYRDAPLPAAESFRDWWRRNDPRT

SEQ ID NO: 15017 - protein, 203 aa, Actinoplanes utahensis
MTHARDEILSRLRRALSDSPAVPQALPLPTPTQPPDALALLCERLLDYRAQVVTTTWHLLPDMLTELVTGVADDIAVPADLPSRWTAAWQARAVVDRGHLSNAVLDQVGAVVTGCALAVAETGTIILDAGPRQGRRVLTLLPDRHICVVDARQVVADVPDTFARLDHSRPLTWISGPSATSDIELRRVEGVHGPRLLQVVLVS

SEQ ID NO: 15018 - protein, 227 aa, Actinoplanes utahensis
MILGYAVLAYVTFLFSIGWAVVFLTGPVDGPATHSPATALTVDALLLLAFAVQHTIMARPRFKRHLPAAVERSTFVLAASLVLVALFAWWEPVPAVVWRGSPLLWVLYAAGWALAVAATYMIDHFDMFGLKQAVRRDAYQAPAFRERWLYKRVRHPMMLGMIIAFWATPTMTVGHLFFAVASTGYIAIGIRFEERDLRRQLGDTYAEYAARVPMLIPGTRRAHSKVA

SEQ ID NO: 15019 - protein, 643 aa, Actinoplanes utahensis
MDPFTRVPLGRTDLTVTRLGMGLAPIAGLFRPVGDAGAIAAIDAAGDAGVRFFDTAPLYGAGLSEVRAGRALRGRRGFVLSSKVGRRLVPAGETRNELWSEPSGAAQVWDFSDAGVRTLWRASPDRLAVDRLDILHLHDPDDHFGQAVHEALPALVELRRQRVISAVSAGMNQSAMLTDLVRTGQLDRVLLAGRYPLLDQSGLADLLPECHARGVAVICGGVYNSGILTDPDGSPTYHYRPAPAALAARARAIAAVCDRHGVPLRAAALQFPLAHPAVVSVLVGMRSAAEVADAAAMALPGPDLRACARTSTSLPIFRVGPAHVRCEPAGVRGGGVLRGGHSGAHRHSRRPLRRCVRPHRDPRLSMGDLVRYLRAGAPGAERPILYAGGRLRDLSEVTADIDGAFLAAGGFTGDPDELPPADLDHHRIAPPIARPGVVLCIGPNYAAHAGESGAAPPAEPIVFSKAPNTVIGAEDDILIPPGSKRLDGEVELGVVIGRQARYLSDPAAGLQCVAGYVLSNDVSERDYQLERSGGQWSKGRSCETFNPLGPWLVSPDELRFPLRLRSWVNREPRQDSSTADMIFDVGHLIWHLSQFTVLEPGDLINTGTPQGVALGGRFPYLNAGDVVEMEIDGLGRQRNVVKG

SEQ ID NO: 15020 - protein, 907 aa, Actinoplanes utahensis
MQQESIEKRTVRWRRLVTTVVAVLLFWVGAGAAAAEAYVESVPVPGVSPEPQASVLYYRDGRTILARVGATDHNDVALSAVSPELRRAVLIAEDRDFYHHVGVSLRGVMRAMVADAGGAHQGASTITQQYARNAFLTQNVTVNRKAREFALALNLEREHSKDEILERYLNTIYFGRGAYGIAAAAHAYFGITPDRLDFAQSAVLAAVIKDPWGYDPDHDAKAARRRWNWILASAQANGWVDPAVTYPQLQPAGSPIGGPLGLVVDQVERELSTHQITSQQLHTQGLQVVTTLDAAAQQAAVGTVAAQLHGQPSGLQAALVAVDPATGGVRAYYGGEHGSGYFDYAAALHPAASTFKPIVLAAALGRGIAYQSHWDGSSPRLFPDRGVPLRNHNDLQCADCTLQHAMVDSLNTPFYAVTAEIGPDRVRDMAVKLGIPDTYHGAKSMVDVKGDPAPGHTRGDIAMGRYPVTPGDLATVYATLAGNGDRHQRHFVRSVTGATGFDYTEPTGGTAAVDPKIAADVSTVLRSVVQEHGFTPGRPAAGKTGTQQYLETRDNQDAWMAGYTPELATAVWLGRAKPGPLRDAKNKRIEGDTIPAQLWREFTRSALQGAPVTPLPAPAHVGRADTGDFGKTGHGGHSPDSVTDLHAAAAGYEPVVHTEHPGKRLALTFDDGPSDYTPAVLDLLARYHVKATFCMVGENAGWYPQQVRRIVADGHRLCNHSMHHDDLGIVSEAKSRADIAETDAAIAEAVPGATVTYYRAPYGDFGPSAKAGGKAGHTPLGWVVDPDDWTLPGVDTIVSRIRAQLTPRAVVLVHDGGGDRKQTVEALRKLIPGLLAEGWTFDFPETTITSSPLPGPHAGATTPAPSPSSASPSASASPSPSASTSPVPVPTPALPAKTDAPRPDTTP

SEQ ID NO: 15021 - protein, 179 aa, Actinoplanes utahensis
MGSCRRGDSAGRGSQGSELSMSHAADDTIGSDPLAVMTLSYLDDPEIALRADDLEAEHRTNTWHYSVPNRFDLTAVAAALEHVVRHLAKRHGPGPGIFYCWYDEQAGQLRCSLTSKPADSLPFGGRYRLTPEVTDVLLLAASDAQPGRIPWTELTEVQNSADLSRQNPDPFPVWAAALS

SEQ ID NO: 15022 - protein, 51 aa, Actinoplanes utahensis
MEVPFTRDALRRMLGGVGVPHLAVRLGLQDPEHTAPPHTPRLATEQVVEIV

SEQ ID NO: 15023 - protein, 216 aa, Actinoplanes utahensis
MIRVFLLDDHEVVRRGLIDLLQAAGDIEVVGESGSAHEAAARIPALRPDVAVLDARLPDGSGIDVCRDVRAVDSTIKGLILTSYEDDEALFAAIMAGASGYVLKQIRGTDLVDAVRRVAQGQSLLDPAVTQRVLERIRHGVEQPRELAGLTDQERRILELIAEGLTNRDIAGRMFLAEKTVKNYVSSLLAKLGLERRTQAAVLATRLLGDHPHGGS

SEQ ID NO: 15024 - protein, 571 aa, Actinoplanes utahensis
MGDPIAGDGPPSLGLSPLSRVRLDELLHEMLDRVGEVMSSRERLRALLDAVVGIGSDLDLRSTLQRIVEAACALAGARYGALGVIGADRTQLADFITHGIDPAAHARIGDLPHGRGVLGLLITDPKPVRLPDITRHPDSFGFPPNHPPMHSFLGVPVRTRDQIFGNLYLAEKQGAAEFSEDDEEIVVALAAAAGVAIDNARLFAVAQRRARWLTATAEITSVLLGDVQRTDALRLIARRARELSGSDLVMVLLHDEVTGRYTVEVADGADPGCATLTGRSLLVEDTALADLGRETYRHVPRLPTVADWPVPVPDGPALAAPLSGTDMLHGVLLVAQPSAQPLGDEDAVLLASFAGQASLALQRARAQEERGLLLVLEDRERIARDLHDVVIQRLFATGMQLQAAIVHATRPEVADRINTAVNDLDATIRDIRSSIFELRAPVGPSLRAELREAVTAAAGTLGFTPVLDTTGPIDSVVPDDVVPELLAVLREALSNVARHAQARSARVSVHAGNTEVTLRVEDDGIGFDPARARGGLVNMADRADDLGGTFSTGPRADGTGTTVTWRVPLGT

SEQ ID NO: 15025 - protein, 328 aa, Actinoplanes utahensis
MATYDDTDLHRAAAAGIRAPSLHNSQPWRFRLAGGAIEILADPSRQLRVADSAGWAARLACGAATYNARLALAVAGRPADVLLTADSDRPDLVARLTPGRERPPTYAEQDLHAAITRRHSHRNPFWPDPVPATARIRLVEAARSEHAWLDLLVGMAALAGFAQIAHSADRVLRRDTAYQAEMIAWTDAGSAPDGIPAHAGAPITEPQDLLPQRILSDRHRAPGRDYEPEPLIGILGVAGDRRLDQVVAGQALQKVLLTATAAGLATSLISQPIEVPAARDQLRRSLGRTGYPQLALRVGYGTTTGPLTGRRDVPEVLTGAPVTQAQSR

SEQ ID NO: 15026 - protein, 392 aa, Actinoplanes utahensis
MGAIVTRAAPIGSGHSCGSDAATAAAESVLQALGGRVPAAGDLVIVFPTFDLEPAIVLAAAEAAAGDATVVGCSSFASFTEAEHVSAGCTAVYVPAHGASFGVAAGEPLADDIAGVTRQVVESARAKAGVRHPHSVLMILSDGLAGDQREVLRGAYAVAGATVPIVGGAAAEPLRMARTYQLGEGRVLHNGVVAVWINSPVPLGVAVQHGWRPTGEPMIVTRAEGNVIREIDGRPAREAYLAMRGCGTGEDTGMSFAGLVMDRPLGLPNASGRFDVRHILDCTPDGGLVMFGYVSDYAVVQVMESSFEELIDAARQATAEAVGQLAGSPRGALVFSCTARTALFSERVGAEAGAVRAALAGAQAGGLFTYGEFARVSGSSGFHNATVSVLAF

SEQ ID NO: 15027 - protein, 492 aa, Actinoplanes utahensis
MTDTIPADVVPADSAELARLQEEVRQLRTQIAASHATSARALSRATRLAQVVSVLGQLADVDDIFARAAGEVAELFNADVALFWLVTDHGVELSGCWGIPAHDLPANAAELPPDLAATRRGETVTAGPAGQVPLPAWLNRDGVQHAAWARLASGAENLGYMLLIRHSESPFDAADSLELRAVASRVALAVDNTRLQRRTRMQLERLRRLHDLTSNLVGMLDLDEVLHAVARMTIAEVPVDDVTIALHGDHPEPISASAGKVLPSAADQADGPDTTALRLHAGGREVGTLTVHGAPPAGGEADALLRHLADLAALVISKALLFQRVREQAEHDTLTRLANRALFMERLEQAVVDAERTGGTVGVIFADLDKFKAVNDTYGHDVGDALLVAMAARLSAAAGPAHLVARLGGDEFVVLCAPLTDPAEARAVADRLGRVLEAPFELGGTRLPAGASFGLATTGEAGYDPEALLRAADEAMYTAKAAARTAANRAEP

SEQ ID NO: 15028 - protein, 246 aa, Actinoplanes utahensis
MVWLEDAELSPGAAGPFDRWLTPRRELFWRVGDRAIDGPVAKLGGQPFWLDEPFWPVSGTSGAAMTFVGQFPLPGPDTRMAYLFLSDEDGTFLAEGWENALLVQPGGRVPGFVRGEARRSGPSLWRRGASWEDRVPAELSLDLRDPDPADAAAFERAAAFQRAARGGLPEPDDDAYVEWRSYVGGEPILWQPWTSEVLDDSWRFFFQLDGSDGWGGNPFTLNFGGGTGYAFLSEDLREGRFYWDCV

SEQ ID NO: 15029 - protein, 450 aa, Actinoplanes utahensis
MSTDADAALFGNRFVTQEVPSRTFPDEGMTATDAFRLVAEEMALEGDPARNLATFVTTWMEPEAQRLIAANLHRNFIDHAEYPLTAEIEQRCIRMIADLFHAPGETTGARTQGSSEAIMLAGLSLKWNWRKRRGDTGSPNLVFGGDVHVVWEKFCRYFDVEPRIVPLRPGRYTIGPEDVEPHLDENTIGVAAVLGTTFTGHKDDIAGLNHLLLRIRGERGLDVPLHVDAASGGFVWPFLYPDSPWDFRLEQVRSINVSGHKFGLVYPGIGWLIFRERADLAEDLVFEENYLGKTDKTFTLNFSTGSAMVLAQYYNLVRYGRAGYRYIMANMRANARTLGEKLAAMNRFELIGADQEQLPLVAFRLAADNGYDEFDLAWQLSAERGWMVPAYTLPPNAQHVTIMRALVKETMTRQHVDLLAEDIDDACATLDNKGGAHESERRRIITGPGH

SEQ ID NO: 15030 - protein, 198 aa, Actinoplanes utahensis
MTAAGVVDTAALSMLWDDRWPGCSKLPYELRDVRDRWIRFHTLPGSKRYPGSDAEYEMVLARHNNILDELVTGPTVLVATAGYSDTAQPQQPCRSPETLAVHPRAVYWTSVCIDDEPGFESWMHLYVSRLSWSVGCLDPLLRRVADDVIANVLVADPGLRWLYHPYDGGMDVMLSTTAERDALRDRHQDWLSSHPGGL

SEQ ID NO: 15031 - protein, 176 aa, Actinoplanes utahensis
MIRIRFAGIAVAAAAVCGAAAWTVTGSPSSFAGSPASFVSPSASFAGSPDPVGDVPGAAAQSASPQRREENTSRSGSGARPRPHGAPAPFVQQFAAQPGRARVRPQKSPKTPVKVAPTVDGCDRNYGTQAQCIPLVYPTGVTDHCAWLAAHGFTHIKVVGKDRQKLDADGNGTACG

SEQ ID NO: 15032 - protein, 697 aa, Actinoplanes utahensis
MTHPHRPLMSRRNRLRIAQLIVLALALFVGLPQLPAGASANLVGNPGLEALDSTGFPVCWEKSGWGSSGYSFAVSHTAHSGANAMQISISSAGSGDRKAMMLEDTSCAPNVTPGHQYDLSAWYQTSTANTVMTMFRHDVAQGWVYWTDLATLPVTTAWTQKTVRTPQVPANTDQIVWGITIYGVGTLLTDDYQMNDATQPAPEQSCSAGAACTQGTWAVMPFNSPVRSIHSVVLRNGDVLLVAGSGNNPDDFAAKTFKTAVYHPSNGTFTTVATPADLFCSGHVQLPDGRVLVMGGNKDYPAADGSHGYEGLKTSYVFDPATNAYTRVNDMTSGSWYPSATEMGNGDIISLGGLGEDSSGTVATQYFATAQQRWLGLNEAHQSWNFWGLYPSMILMQDGRLFYTGSHVFGNGLPGTGSSIYNYTANTITPVDGLRQKDQRDQSMSVLLPPAQDQKVLTMGGGNIETNPDAHRLTDLIDLKQANPVYTAGPALPGGTLTGGVPETGTQGKMYVSAVLLPDGKVFETGGGLHNRADPVYEASMYNPATNTFTPGMATDPVPRTYHSSAFLLPDGRVMAVGDNPGNGTFDMRISVYSPPYLANGARPHITAMPDTQWAYGTSHTITVDAPILKAELIRPAAVTHSSDPNQRFVDLPMTVTGNTIGLNLTSNPNLAPPGWYMLFAVGTNGVPSVAKWVHVG

SEQ ID NO: 15033 - protein, 301 aa, Actinoplanes utahensis
MTPGSRARAIVTPGSPIRAIVTPGSPIRATVTPGDKTVPLDRYRKPGRTRAVLPGEIGVPGARTALRQSIIVPTYNERDNVHALLDRLAAALPHTETEIVFVDDSTDDTVALLRDLARTYPMPITVHHRDDGAGGLGGAVVEGMRIARGEWIVVMDADLQHPPEIVPDLIAAGMRDGADLVVGSRYTAGGSTGGLADGYRKLVSRGSTLLVKTLFRNSLLAVSDPMSGLFAIRASSLDAGRLRPLGYKILLELIVRNRPGRVVEVPYTFQARFAGESKSTVSEGLRFLKHVGRLRLGGRPR

SEQ ID NO: 15034 - protein, 522 aa, Actinoplanes utahensis
MSLLLDAADDRTQAIATATEQPARRRRRGRNPETYLMVTVTALILTVYALNITGFPGASDDEGTYLAQAWAVAHGRGLAHYTYWYDHPPLAWIQLAALSWLPGVFGVHSPAVAAGRIAMLPVIAASLMLVYTICRRMGMAVWSATAALLIFGLSPLAVTMDREIYLDSFAVAWMLGALALVLSPRRHLWHVTAAGAATAIAVLSKETMLVTLPAVLVALWQNAARSSTRPWAIGGYASGLVLVGAFYPLYALLRGELFPGPGHVSLIGAWQFQLANRSGSGSIFTTGSGANQLLHSWLFYDPIILIAGLVATVAIVAVRRLRPPAVAGLILTLVALRPGGYLPAMYVVQILPFFAIAIAGALDQLAVLAPRRWIRPAALAVLALLAAVLVVPRWWTGNERALTAEDNAGYAAAADYLRTAVLDRAHTTVVVDDVLWLDCVRAGYQQQKVIWFYKLDLDPAVKATLPHGWHDVDYIVSTPALRQDPSALPTVNTLLTHSTVVAGFGPDGGRIEVRRINRQENS

SEQ ID NO: 15035 - protein, 423 aa, Actinoplanes utahensis
MAAAVMISISVVLSVFAAVTLWWTMHAWRTPETLAATRFEEPDGDHRVTFSLLVPARHEQAVLEHTVERLLRSTHQGYEIILIIGHDDPETAAVAHRVAASAPDRILVVTDHNEVKNKPRALNTALPYVRGDVVGVFDAEDQVHPDLLEHVDHAFRATGADVVQGGVQLINFHSSWYSLHNCLEYFFWFRSRLHLHADKGFIPLGGNTVFVRTDVLRTANGWDGTCLAEDCDLGVRLSSRGAKVVVAYEASLVTREETPDSIGSLLKQRTRWNQGFLQVLRKGEWRRLPSFRQRLLARYTLTGPFLQAFSGLAIPVGVGAALWADLPVGIALATFVPVVPMLANIVFQTVGLRDFGLQYNLRIGFRHYAWLTLGAFPYALVLSVAALRAVWREYTGRRNWELTAHVGAHLHGNATPAEAGAAA

SEQ ID NO: 15036 - protein, 337 aa, Actinoplanes utahensis
MPTEDDLRTAMNEMARSTDPLPPTGVLHLAHRRRTRRRLAVVTAAAAAVLAVPVAITVLGPDHRADRPAAGTALPGDARQALRDSVTALAAGDYTFTRSGASDVADIRQGVVHLPDSVLIEHSDTFAMARVGPHFYLKYLLDANPELRAQLLGYYRKHLSGAQLRSVEQSYARLDGEHWVAADEKKLIAAAAIEEQSGLDSMARLPDARRPDATGAGTLIAAVTSAQRSGTVITGTLDATGKDPELQKLFNDPTYLYGVGAKAMPYRAVLDDQGRLTEFTVSMPDQRMASQPAEPITPQPPLVIRISRYGQTGVQPAPATSGEVTAQDYELLSTDTD

SEQ ID NO: 15037 - protein, 200 aa, Actinoplanes utahensis
MPTRSAGGSVNLSPGHAVLVIMRVRQRRHTDETFSAFVAARSGRLIAHAELLCGHHEQARDIVQSALVRAYRRWQHIEQDDPYGYLHRAVTNAVIDWWRTAHQRHEQPVDVLPDLPPVMENTVEDRHSLLAALDALAPRERAVVVLRYLDDYTERETAEALGVTLGTVKSTCFRALRKLRVSFADPASGESLTEHTDHRP

SEQ ID NO: 15038 - protein, 62 aa, Actinoplanes utahensis
MACFRDSPGAAGRHAHGHHTHHGMRDRPPGEKKIVNVRTPLVVAAVVTAAALTGCSSTATTS

SEQ ID NO: 15039 - protein, 67 aa, Actinoplanes utahensis
MLAPTDTLTEITCYQGYALALTHPKEADNARAVFHYTGGAWHGIGGGTSDYCEGIVPAAVQPHLKHC

SEQ ID NO: 15040 - protein, 199 aa, Actinoplanes utahensis
MWIPSDAEIRQLHERVAPTPEAFDLVWTHCEIVCRIAEQLMARRELGVDPDLVRAGCLLHDIGVYRLYGRDGVLDYPNYIRHGLLGHQLLEAQGWPDYLCRFCSCHTGVGVTRADVLDQGLPLPPGDYVAETPEETLVMYADKFHSKKNPPVFVSAAAYTVSVARFGPGKAQRFGEMVTAYGEPDLLPLATGYGHRLTA

SEQ ID NO: 15041 - protein, 245 aa, Actinoplanes utahensis
MSANHSRRPWVSPDRIRRECGVGLPMRRPRPGRRVVSGAQDPAATRWGETVETLQAHLFGRDIDGLAALLVRAGVRVTPLRDEPQATVVVSGATVAEALDACPETYRKQRFGLLVVAESLDAAGVRHGFRAGVRAMLPRAGVTPDRLAAALHSAGQGDRRIPYPAMVKLLAGAAPAPRELSAEPLTPQQARVLRMIAEGQSNAAIARDLACSEHTVKNAVYDLMARLHVNNRAHAVARGIRTGLI

SEQ ID NO: 15042 - protein, 194 aa, Actinoplanes utahensis
MNVSVIALDPVLEAGTRSALSDRPGVAVVGVGVPAAVTIVIVDEVDEQVLDLVRLTRAAPHRPEVVVVATEVAQPQALHAIASGARGLLRRREASAARLTRAVLAAASGDCTVPPDLLDDLLDTGARGPAVAGLTDRERAVLRLVADGRETGDIARTLSYSPRTVTSIVHDITQRYRLRNRAHAVAYAMRVGLL

SEQ ID NO: 15043 - protein, 432 aa, Actinoplanes utahensis
MAIAPVTRQVKRASDFSVFEDLESDVRIYCRKFPAVFHRAKGAELYAEDGRMFIDFFGGAGTMNYGHNNEYIKSRVTGYLAGDGLMHGLDMHTVAKREFLSAFAELVLRPRDLDYKVQFCGPTGTDAVEAALKLARKATGRTGLIAFTGAYHGMSRGSLGVTGGLRARRAGGVTAQDVTFIPYEDGPHGAFDGVALLERLLDDPSSGVARPAAVIVEPMQMEGGMYPASPDWLRRLRAVTEKYGVLLILDEIQAGCGRTGTFFCFERAGIVPDVVTVSKAIGGYGLPLSMTLFRRELDAWEPGEHTGTFRGNQLAFVAATAACELWQQTQFRTDVVAAARRLERFGAEIARTHPGVAVRGLGTALGIDLGRDGGGGGPERAALVQRYAFDHGVLVELCGRHDEVVKILPPLNIDIPRLDRGLDVLRDALGTV

SEQ ID NO: 15044 - protein, 299 aa, Actinoplanes utahensis
MRTRRHLISIDDLSDEDLRWIVRRGAEYSAGTAGGGRPLDGDIVGVLFRNTSTRTRTAFSAAALRLGGRLITYGPQDLQENTGETAGDTGAVLSRMLDVLVVRTAGGDAELRAYAASRRMAVINAMSASEHPTQALTDLTTLTRHFGGVDGLRVLYVGEGNNTASALCLALSRFPGTELHLRTPPGFGVDRSFLDRAGSRVVQRHDMTDLPKVDVVYTTRWQTTGTTKPVPNWRELFAPFQADDAVMAATGAGVFLHDLPAHRGEEVTAELLDGPQSIAFEQAENKYHSARAVLEWCSR

SEQ ID NO: 15045 - protein, 408 aa, Actinoplanes utahensis
MVLPVSRAGARAAMYTAGGISSFGTQMTMLALPWLVLETTGSAARTGVVYAVQVLPLALLGFAGGGVLQRLGARRTMLLGDALRAPLVAAVPILHAAGALSFGLLLTLVAVVGVCGVPYAAAQRVLAMDLIGASPGALTRAYGVLDGVYNAAALGGPAVAGTLIAVAGAADVLWIDAASFAVSFLLLLTLVPGGAGRAAAAGRDRGTWAGLRYLRSDRVLGQAVLSTVLFGLVLRVLALSLPLLAYTRFGHDARAGGLLVAGSGAGALIGSLVTYLVSTRVEPVRLARAAMVMIALPLWFLLWPAPPAALVVAVAVSSAAVTVSNAPYAAIVSTRAPAGVLPAVVQTVITISTLAGPLGLLLAGVLTDRAGIGVVLLAVAGTATIAAVNVLVALSRLRPAPERTLGHV

SEQ ID NO: 15046 - protein, 767 aa, Actinoplanes utahensis
MSDQVHLAGGWRLWSQFALRGPGFPADGVLRLAPAGLAAAADKAAQAPPAGPEWADFTGLYDAAAVATALELQRVAALPAFQAAVAWQNRAVLGTGIRPFLAWQPSAAGRTSMPRQREELVAHYWQRFCVKNDTIGFFGPVGWGRIDRTVPGVVVDPGDRFLAASEVYFSSWAIDAVAKTVEQIPGLREHVAPRRVSYARIGADTVTVAGSPAQPIDAEARRILALCDGARLPAEIAAATGRPAGEVLDVLDVLARRRWIVWRLEIPADTHPDRWLRATLARIADPRIRQDALSRLAVVERGRDRVRAAGRDPAALLDAFDRMETAFAELTATAAQREKGARTAPCRALTYADTRRAATVRVGAAVLAELTPLSFCLTAARWLVHRFAEVAEGRIRERFETLRAELGTVDLASLWMRCIPNPYAGAPDDAEEIRRELQRRWAAIIDAPPGARRVRLRAADIADRVAAAFDEPGRGWALARYASPDVFVLADSAEAVARGDFELVLGEMHVGTNTLTQSLFVMQHPDAAELIAETDTDFPGPRLMPMLPKESKALRWSTRSRPALIRPADYLVGVVDHTADPHRPRTLAGADVLVEERDGTLEAVLPGGERFPLLDVFGNALTNQVMNRFAVQPDEGHTPRVTVDRMVLSRETWRLPADTLRFAAEKSEAARFVAARAWREHQGLPRFAFVVSPAEPRPFYVDFDSPVYVSILAKAIRRLSRADPVAVLTVSEMLPTPEQAWLTDDQGARYCSELRFVAVDQSTGGPR

SEQ ID NO: 15047 - protein, 484 aa, Actinoplanes utahensis
MMPTFVSELPDGDTPALITPGGSLSRRDLHHRSRALAWALAARQAGPEKICVVALADGVDRIVAVTATVRTGAAFLIVDTDLPDQRLAALARGADLTITSAALAPRLAALGLPGPAVLVDDTHPELPLPTRVAPRSLAYVSHTSGSTGTPNAVLIEHRWMHPYLRGIVRDYDLGPDTVAVQLAPPGFDAALRDTYAPLVAGGRLVVLPRATLLRPAQFFAALAEHGVNSMLSVTPSFLTFLLGQPGAEQALRGLRLVATTGEPIRPFLLAGGRRLIAGRLINQYGPTECTMTTTRFEVPREPDTSRDVIGTPVDGTAVRLAAGGELCIAGPGVARGYAGRPGLTADRFVPDPDGPPGARMYRTGDLARRGPDGNLEYLGRRDRQIKIRGYRIDPGEVEGALLTHPAVTGAAITAAADDRARTYLVAHLTGDLAGVADAALRAHLARTLPPHMIPRRFARLHRFPTTRTGKVDRLTLAASERTAR

SEQ ID NO: 15048 - protein, 76 aa, Actinoplanes utahensis
MSTNQTTDLTELITEIYRETLADATLGPDCDFFEAGGDSLAAFQITARLQEHLGTDVPVALVFSYPTPADLAEWVR

SEQ ID NO: 15049 - protein, 764 aa, Actinoplanes utahensis
MAGSESTPLLLGGRFRLWEQFALRGPGFPAEGVLRLVAPELSAAALSEVPSPEAAFPEAASPEAASPEAAFLETYDAAAVKTALTLQEIAARPDYKAAVAWQNRALLDRAVRPFLRARPASARTSKDRQREELVAHYWQRFCVKNDTIGFFGPVGWGRYDPGVSGLVVEPGEGLVERTNIYFASWAIDALARSLGADPVLARWVAPRRVPFVTTAAALPGCPAQDLSPELLRVLRYCDGIRTPAAIGELTGTDPTEALSELVRRRLVHWRLDLPADAYPERHLRAWLEGVGDDDARRRGLDRLDRLERGRERVRAATGPGELAAAIEALENDFAALTDAASAREKSAGTAPGRGLIYADCRRSASVRVGGDVVAALAPLELLLSSTTWLTSELARRFRSRIRQVFDESRPADLAAFWFACMPVVHRDAPADAAELQQEFWRRWQDILGPCSDARRVRLRLADIEERVHHSFPSTGGGWPSARYLSPDVMIAAASAEAAGRGEFALVLGELHVAINTLGAALYLHQHPNPDEMLELTTRDHPAPRLLPMIAKENRSRLSIRIRYSLARPEDHYVALADFTADPRRPRTVNCADVAVQADGDTLFAVLPDGTRYDVVDAFSHVLTTLVMDRWRILPEADHTPRVTVDKVVLARETWRFPAAEQGFADAKTEALRFAAARRWAAERQLPRFVFVTSPAEPRPLFVDFDSPVFVNLLAKAVRRLVRKDPAARLTVSEMLPTPEQTWLTDDQGNRYTSELRFVAYDTAR

SEQ ID NO: 15050 - protein, 269 aa, Actinoplanes utahensis
MTTTPGTIRVAIQIPPSRADYAAIRRAVAEADALGVDAIFNWDHFFPLGKDPSGKHFECWTTLAAWAESTGHAAIGALVSCVAYRNPDLLADMARTVDHISDGRAILGIGAGFREWEAEEYGFAFGSPAQRVRELREALHRIERRLQLLNPRPIRRMPILVAADGPQALRLVARYADIWQTFAEDDVFSEKSRRLDGFCDELRRDPATIERAVFVDGDPWTVAAPLRARGAGMFTLMTRGPDFDLDELRRWLAWRDEENARLPVAARNP

SEQ ID NO: 15051 - protein, 249 aa, Actinoplanes utahensis
MVTTFSGTGQFAGATFVRTSFQGATLRFSDVSGVTMRSVEVDGLDIDSHDLFSGRLLVNGVDVVPLVDAELNRQFPGRELQRAQTPAGLREGWAAVRAAWQTTVADTPPDLVDAHVADEWSLAQTLRHLVLATDAWLRGAILRTPRPFHEIGQIFTGADRMGFDMSIFRTDPPAYAEILTVRAERQRMVTDFLATATTDLLAEQRDNPWGGGDRRPSVGDCIRVILEEEWAHLRYIKRDLARLRQRPAT

SEQ ID NO: 15052 - protein, 235 aa, Actinoplanes utahensis
MTDPVTPPRTFGSFHALAARLLRDGYPDPLTDADIQQHADAAVARIRANPGNGRAQPPIDVIRQGTRRLGTHYDLSEADLRGANLRGVKLIEVILFEANLFGAKLSWADLTRANLRGANLHQAYLIGADLTGANLANADLNESHLIGTYLIGANLTRANLGGADLRGADLRGADLRGAWATPARLDEAVWDRSTVWPAGWSTWIADRSEPLPGGGYRITSDQPGADDRAASPVSR

SEQ ID NO: 15053 - protein, 170 aa, Actinoplanes utahensis
MRSPCPRWPGRCRWRAGWPPRRSSVPPSASPSSGPLPPAAAARSPMSSAPRWTTRMPDWIPEIPPLKNLVYAHSGYNVPDGFAAAFVVLHDHDWPAAEDHWERAVQAVFNTDAVAKTATGDTAVRQAVTATADFFTTRRYFPWCCWCRKGTPVPTEELARASATGKEATE

SEQ ID NO: 15054 - protein, 2108 aa, Actinoplanes utahensis
MELPADRPRPPVRDPAGAFLPFVIPAPVARKLSELARRRGATTFQAALAGYLILLSRYTGLDDIAVGTTVAGRDHPQVQDLPGLFVNTVVLRADLSGSPSYSDVLDRVRDVTLDAHAHQDLPFERLVEELAPGRDPSRTPLFSTMFLMDDTPATVREAGGLRFERIPVGESSAKFDLTVAIAERPDGSLAGGITYATALFDRATVERLAGHLGQLLAGAVADPRSPADRLDLLTAGELRQLTRGGNGSVQTYPGGTLPALLEAQAAGTPTATALRYEGREWTYAEVNARANRIAHHLRGLGAGPESVVAVELPRGADLVFALLGVLKAGAAYLPLDPEHPADRRAFMAQDAGARIVVTERLLADAEGGDDSDPVSGVTPAHAAYVIYTSGSTGRPKGVLIEHRAIVNRLQWMQQTYRLDAGDRVLQKTPAGFDVSVWEFFWPLLTGATLVVARPGGHRDPAYLAALIAAERITTLHFVPSMLRAFLAEPCGTLPSVRRIICSGEALPADLADAVHERIGGELHNLYGPTETAVDVTALRCLPGEPVTIGRPIANTSAYIVDDRGRPQPVGVPGELLIGGVQVARGYIGRPGLTADRFVPDPFGADPGGRLYRTGDLARHRPDGTIEYLGRLDHQVKIAGQRIELGEVETVLRECPGVTDAAAAVADGQLVGYVVTDTSVDDIRAHLRRRLPEAMIPARWAVLAALPLTGSGKLDRRALPDPDAPVPTGAYDAPHGEVENLLAGEFGAALGIAKVGRHDSFFQLGGDSMRAIRVVGAARAAGIALRVQDMFTHQSVAALAELTGSRAESSPERPVEPFTQISDADRRLLPPGLSDAYPITQNQAGMLYEMLSGADRAVYRNVSCYRIRDGKPFAAGALEQALRLLLVRHEILRTSFDLGTYSEIMQLVHERAELPVEVRDLRGRPAADQQDAVRSFLAAEREVPFDIGRAPLVRYTVHLLSDQEWLLTHAECHAILDGWSHTATVAMLIDLYRGVRDGTPPELPAPPGVRFADFVHLERAALDSTEDREFWAATVASRDRFELPPEWATEPAGAPATIVDVPWADLAPGLKRLAAAANASLKSVLHAAHLKALSVATGQERFFDGLLCNGRPERLRGDEVFGMYLNTVPFAADTRARTWRELVAGVFAEEARLWPHRRYPQPTMQRDWGSASRLIEVAFGYLDFHVLAGEAESGVRMIDDFSPGSLALEVWTFPGVLRLGADPARIGRPHLELLRRTYRHVLEAMAADPGGDARAVGLAAADRHDAVDRFQNPVAFPALPLLHDLVPTGAAVALRQGDRTLSYDEVHALAGGLAARLHRLGVGPDTVVGLLLPRGTDLVVAMLAVLRAGGAFLPLDPAYPAERIRYMLDDAAPAVVLTDPAYAALAPGAEIVDHEAYRTLPAAPPPALNGENLAYVIYTSGSTGRPKGVGVPHRALLNLRHAQNRHLDVRPGDRVLQFASPSFDASVWELAMALTNGAALVLPPPGTDPGDLRAQAGVVTHMTVPPSLLDRLRPDDFPHLRVLVTAGEAVTAEQVARWAPHTRVVNGYGPTETAVCAAAAELGTSAPAGPPPIGQPFANARVYVLDHDQRPLPAGVRGELVVGGAGVSRGYLGRPALTAERFVPDPYATVPGQRMYRTGDVASRSAEGTLSFHGRRDHQVKVRGFRIELGEVEHALAACPGVTGAVCTVHRPGTPDATLVAYTRGGVPAADLRAHLADRLPQHLIPTHFRAVDDFPLTPAGKVDRAALPAPDGSRPATGAAYTAPRTDRERHLAQAWSEALGVARIGADDDFFDLGGHSLAMMRVIAALRSRHGYELTFRSFLEQRTVARLAATLTEQSSGRALMWLRDGTGRVPLICVHPGGGSAHWYQRLLPHLHPEQPVAAFEWPGPHPQGTPSTEQMAARYLAELRDARLEGPYRILSWCGGSGIAMEMAHRLIDAGEQVTVMLLDPGLDMHSRDDGWSELALMRRLEALLAEGADTPQRRTEILSLLDHLVDDVDPATGIVLPEGGAGHWPAAVRIWREVMEMDMSYRHRVFPGRLELIASDELVRGEHEVASGQSYGDYLARWRELVTGGVRVHRVPGDHFSVLREPHVRRFAELITGLLDDA

SEQ ID NO: 15055 - protein, 483 aa, Actinoplanes utahensis
MRSTSWRATRVSSARRRAGSSSGPVRRNTVLARYSVVPGWSWSSSQSRCWAYESGIGAERSAGRGPAAGRGAVTPLSRRRISSARSDAGSMVSVIAHPPGFAGHTRRIIRVPPGRPPGQRTTGAGPVPARLRVLLCAAAVPSDKARCMKTPAFASGITGTIGATPLVELTRLGESSPLRVFAKLEGHNPGGSIKDRSALEMIRHGVAVGRIVPGRSVVVESSSGNLGIGLAQVCAYYGVRFVCVTDPRANQQNIAIMRALGAEVEVVTRPDPATGEFLPARIARVRELAAALPGGYCPDQYSSPLNPQAHHATMREIVEALPAPPDVLFCSTGSFGTLRGCAEYAREQRLAVRIVAVDAVGSTIFGTPRGPRVIPGHGAAVRPALFRDGLADEVVHVDDAACVVGCRRLVALEAILAGGSSGAVVAALDRVRDRIAPGSSCVLIFPDRGERYLDTIYDDDWVAERFGDIAHLWKQNAMEASPC

SEQ ID NO: 15056 - protein, 320 aa, Actinoplanes utahensis
MLILGRADVQRILEDADEEVLRAVRAAYLRHEEGRTAVPHSVFLRFPDDDRNRIIALPAYLGGDDPVAGVKWIASFPANIGAGLPRATAVMILNSMRTGAPEAVLAAETISARRTAASAALAAGTLAPDTPGVTLIGCGVINAAVLRFLRTTLPELSTVTVFDLDDGRARSFADRITGLKVEVAPSIEAALGAHRLVSLATTAARPHLDTDHCRPGAVLLHLSLRDLPVPAVLASSNIVDDADHVCRASTSLHLAEQETGHRDFISGSLGSLLAGTPYRRPADRLTVFSPFGLGILDLAVARLVLRRATERGAGVEFAGF

SEQ ID NO: 15057 - protein, 363 aa, Actinoplanes utahensis
MRISRRQLWTACLAAGLAIPAATAVATSAAAAGSTAGLTATVQIGQVTGSALTVHVTVRNTSRSAIDVLSRDLPQAREIKAVLAVTRDGVPVPYRGRLAKLAAPTAADYTHIPAGGTYAATVNLADDYDLSRPGTFTVALASAQVRTLNAATAARPGTLRVDAGPASVRTSAGIRHAGKAASVAPTTTERVSLAAAAVTLTYRGCTTSEKTALKLAVSNAATFSQKSTTWLAANPSGGGAYATWFGAYSSSRFNRVTSAYNKITGELTGKTVTLDCTSTEDYYAYVYPDEPYIIYLCNAFWTAPATGTDSKAGTLVHESSHFTVNGGTDDHVYGQTAARQLAASNPGNAVDNADNYEYFAESR

SEQ ID NO: 15058 - protein, 389 aa, Actinoplanes utahensis
MRPATRSAAILAGITLALSLTTPAFAAPATATVLYADSATAIGGSYVVVLKRGEADQTRADQITKRYGGTVSHVFGHAVEGWAAKLSAAGRPARRRPLGRLRRGRSAGADRRHPERRTLGPGPHRPAGAAAERHLFVRPERRRHRLRRRHRHHRQSSGLRRPGLVRLRRGRRRQRRAGRQRARHVVAGVAAGTTYGVAKSANLVDVRVLDNNGSGSTSGVIAGVDWVTAHATPGRSVANLSLGGGTSSTLDAAVRRSIGAGIPYAIAAGNSGVDAGGSSPARVTEALTVGATDSSDARASWSNYGSVLDLFAPGVSITSDWRTGNTATYTGSGTSFSAPHVTGAVALYLAAYPGASVATVNAAIVNAATTGVVTGAGSGSPNRLLYTGS

SEQ ID NO: 15059 - protein, 182 aa, Actinoplanes utahensis
MTHRQRLSMIAVMVVAALGLSFTGASAAGAAPDTPVAAPPVTALATPITGTATDGGSFAGSFTPARFVARNGRLLATGVLSGTVRDPSGAPVGTVSRTVSLPVTVAAATCQVLDLVLGPLHLNLLGLVVDLNQVHLLITAVQAPGDLLGNLLCAITHLLDGAPAVGPLAALLNAVLALLGRL

SEQ ID NO: 15060 - protein, 273 aa, Actinoplanes utahensis
MAATRPRWPSSVHRGGPTSRPPRRTGAPLCPLADAPSATWGLPADQPPRRDPETGRHPAVPKLFDPGWEAIVIRILLVEPLTLLRGALTATLSQEDDLDVVADLDALGPALDMAGAVSPDVAVINIALMAGDGLATIARFTAGQPRCATLALAGPDESVLLNRALGGRIDGVVNTQAAPCELVRGIRRLVRGERVIDASLAVAMVTAPRSPLSSRELTVLSVAASGMPSTEMAAELHLSPGTVRNYLSAILRKTGARNRWEAVRLAENAGWLT

SEQ ID NO: 15061 - protein, 285 aa, Actinoplanes utahensis
MRHPAAHGEDHAPGGTRRVVRLLLLLGVAVAAYLVLTLFDHAARADTGVGDRPSGSLGAPAAVDPLTTVAGGVTRAVAHAPVPGAEVHRPTIAAPRRTVAAPRIRAAAPVVAAVHASAGATVRRVRAATKPVHHLVSETGRAVLPDTMVPARTAAVRQALPQLDEPVSPAGPAGPAASPGPGMPRSSSFSVRRTPILTTPGAGAPAPRRASPYAPAPSAPVPASPGQPGEHSASTGQIRDAGGGNAPAMAIVCSSWWPDVPATTPHRGTPLPARGRTVRHLGPPR

SEQ ID NO: 15062 - protein, 69 aa, Actinoplanes utahensis
MNDEQTDERTYRVVVNDEEQYSIWLADRDLPPGWSAEGTTGDRATCLAHIDRVWTDMRPLSLRRLMAGA

SEQ ID NO: 15063 - protein, 987 aa, Actinoplanes utahensis
MKRSSRDAVVGRRTPDLAGRDEELHTVQQTLSRARAGHGGSMFVVGAGGIGKSRLAAAAADMAFAADMCLLRGRGSMVGLTVPFRSLTEALLSLVHSGDPVDVTELGPYRSALGRLIPDWADGPAASGGVPLMVLAEAVLRLTALAGRDRGCLIVLDDLQDADAETLAVVEYLTDNLDHQATVLLCTVRSEPCPALDLALAAEQRGSAVIETLGPLDAGGVRGLAASRLGCSPGDLPQPLIDRLTENSTGTPLFVEELLDAAVDSGQLVREGDTWRLTETIRPAVPDTLVRTIARRVEQLDPAARGLLSIGAVLGKRFPLGLVRAVSGLDDRTLLNHLHGEVASQLLVPDEQTPGWYAFRHPLHGEALLRTLTPGHRVDLARRAAAAVEQAYPGLPGEWCLVSASLRLRAQEPGAAARCYLEAGRRAAAQGAASSAVRLLDRARELLDDHPDRTVQAEVIEALVPALAEAGEMERALGMADRFDELPDSRDRRRRADLHTRLAWAANVAGRVDDGLRQVSLARAALGPGAPDEDTVPIDVVEAHVLVDRPGAENLARAEAMTRHAAAVAEARPLPVVACQAWQLLGALTRARDPAEATACLERSRALAVRHDLPIWEIHALVRLGHDEALRDGSTATLEKTRQAALACGAVTAGYHAETNLALHTVLRGDFPAASSLIDRSLGDTMRLKMFETTQLLLLARAILGAHQGRRREMNDAIAEFRRWGGDPEVHAPRVYGLARVFCALLEEDRERAVGELARSRAGGEGNVSGHFGGAHGIGPLLAALSGPGRPQPRGVVPSAAGALRWNRQFALLAGAVTEGRARRAREAAAGVDEALIAAEPYEMARHLCLRLAGEAALDGGWGDPVPWLRTAEEYFHRLDVVPVASACRSLLRRAGAAVNQRRSGTDEVPRELRELGVTVREYEVLRLLVERLGNRALAGRLHLSPRTVEKHVASLITKTGRANRVELADWAAQIVGGAAGSSLPPP

SEQ ID NO: 15064 - protein, 76 aa, Actinoplanes utahensis
MRDDRQATETTETDARSTLLDLVARVPFGVQAAVLAGVLVAGVGVADTGRTEARAAEVVTAFGIASTTCCPPPDPR

SEQ ID NO: 15065 - protein, 122 aa, Actinoplanes utahensis
MAIRGIRAGDDPAAVAQRFTRRPVLRDLSLCHGELGVTEALVVLAAAESDRFVQRVLRWRAGLVLDALERHGPGCGAPDGVATPGLLNGLAGIGYGLLRLGFSAQVPSVLLLEPGRTGKWTG

SEQ ID NO: 15066 - protein, 688 aa, Actinoplanes utahensis
MSLTGDSGRVVDMTEPVTDDVMAALAACLRGLVTPARDLLAGQVREVPAAEAGALADGFAAELGTRLARQAGSTVAAEFDRAGAGGPQRLAALLARLADGPDDLLARHPRLAGRLHGTVGTAVRTRVELLHRYAADRADLVRVLLGGVDPGPLTEVRAGLGDPHQGGRTVARLTFADGRHVIYKPRGVDAYVLLTELTAWLDGALPGLGLRTAATVTRAGYGYAEFIEHLPLDSLAAAERFYRRAGALLALLHAVRAVDLHHENLIACGEHPVLIDAEALFHPDSAPAAVGADPARRMLAASVYRTGLLPMITVGPAGVVDCSGLSGRLGTHSTDGPDWELADGRLRPRPAEAAGHNLPRLHGRELDPGHYDTALRAGLRAGYDAISAGRESFRRLLDKAADLPVRVVFRPTAVYAALLDRATDPELLADEPGPLVPHELADLRRGDIPVFTAVPGRRDVWSSTGAPLPGLLPGTGLDAAATVLAGMNTADRRDQEWIVSATLATRQPVDGHRAAGFLAGPAAGSEAGPDRLLTAACGLADQILARGIADGDRVNWLGLEIVDGARWMVLPMGAGLATGYLGVALFLAQLAGLTGVSRYRDTARRAAGAAGPLLRALAGRPDLAVHVGAGGYDGFGGICYGLTRLAALLDEPALADDVPYGVAAATAAVAAPCPPGLAGGIAGCLAAS

SEQ ID NO: 15067 - protein, 2061 aa, Actinoplanes utahensis
MRGPLDEAALAGALTGVAARHDVLRSRYETVGDRVVQVPGPVADVELSVTDLSGLTAAERDRRLHEIRVAELRDPIDLRRQAPWRAGLVRLGDRDTVLLITVHHIAFDGLSWIRFAEELSVLYAAGRCGEEPVLPSVPRQYHEVAPGGDGHELAGLDYWRERLAGLPPLELPTDRARPAIWEPGGDSVEVTVPAGVAQGLRRIGSTCRATPFMVHLAAYQLLLARLSGRGDIAVGVSVNTRTGAEQANVIGMFANTVVMRTTIDPADDFPGLVERVRRETLGAFGHQHVPFDRVVAAVAPARDPARNPLFQAAFQLAGRRRQSFALAGLAVETCPPIWVGSPFDLSLHLAENPDGSLTGQLVYATSLFSRTRAEQIAAAYLRLLAGIAERDTRPVGVLPIVPDDELHRFAVWNSTALERPTESLPELFLRRAAATPDAVAVRGDAGELTYAELAGRARALAGDLRRRGVTAEVPVGVALERTGDLATAVLAVLLAGGVYVPLSPEYPADRLAYMIADSGAALILTSRAVEERLPAGLPVLRMDGARPAAPEPELPAIAGDQAAYLVYTSGSTGRPKGVVVTHAGIRNRVLWSVERYRMTDADRLLHKTTIGFDAAVWEILAPLVSGGSVVMAPPEGHRDPAVMIDAVIRGGATMLQVVPSVLRLLVADARLAECTSLRVICSAGEALPAELCRRLTGILPVEVVNTYGPTECSIDATAWTWSPADRTPTVPIGSPLPNTRGYVVDRDGGLVGIGVPGELRLGGTGLARGYRGRPGLTAERFSPDPYAGIPGARWYHTGDLVRWRADGALEFLGRTDDQVKVNGVRVEPDEVRAAIEEHPEVEAATVIARRTEAGETLLTAYVVPAVPADLRDRLGDRLPAAMVPAGFVALGALPLTANGKVDRAALPDPAATDPATPAGRAPRTPLEHELTRMTAEVLGVETVGVTDNFFALGGHSMVAIRLVLRVRRALGVALSVGDFLARPTVEALAAWLDETAAPDAGDTADDPRAIRPVPRDRPLPLSPGQQRLWFLDRLTPDSAEYLIPLALRVRGPLDAPRLRRALHDVTARHEVLRTRYAERDGEPVQVIDEPGPIAFEEVDLSGRPDAESTGLDLIERAAARPFDLTREQPLRVTLIRVGHEDHLLLVLLHHIAFDAWSMGIFLRDLEAACTGQLPPAPPIQYADLAAWQHDHAGDTAGQLEHWRERLTGLTPVELITDRPRGAQRDPSGAILRVDVPDDLARKLVELAGARDATPFMLLLAAFQALLARYTASTDIAVGSPVAGRTRPETEDLVGFLTNTLVLRADLSGDPRFTALLAQVRATALDAYAHQDVPFEQLVDTLQPDRDLSRNPLFQIMFDVQHLDRFPATLGGAAIEALRAGAAVAKFDLTLTVQQRAGDRLRCVFEYATELFDAATVDRLAGHYLRLLAGVVADPDVRLSEVDLLGEQDRRLLRQGAPAPREPRCVPQLFEEQVARTPYAIAAVHGAETLTYAQLNERANAFARYLRGRGVTPETAVAVCLERGLEAVIALLGVLKSGGVYAPLDPGHPADRLATTIADADARIVVTTAELAARFTADTYEVVTHFADRSETNPRPVAGPGNLAYLIYTSGSTGRPKAVMIDHQAYAHHCRVIAEAYDITPRDRVVLLSALTFDVAMDQIAATLLAGATIVVSDPVFWPPAELPGKIARYGITIMEITPAYYREVLEYDVGELRGLKLMNVGSDVVTVADARRWHETGLPGRFLCNYGPTEATVTCLLHPVRGALPGEHPSAALPIGRPVDGTRAYVLDRDLRPLPVGVPGELCLGGIRLARGYRGRPGLTAAQFVPDPLSGEPGARLYRTGDLVRLRADGTVEFLGRIDQQVKIRGLRMELGEIEAALARHPGVQAAAVTVVELVPGDKSLAAYVVGRPGAEPSADELRAHLQALLPENMVPAWWTMLPALPLTASKKVDRKALPVPEPLGAGPKRPPRNPAERIVADIWGEVLRCETVGIDDDFFAVGGHSLLATRVLARLQQAFAVRLPLRCLFEARTVAALAAAVEAAVEADIAGLSDAEVADLMARG

SEQ ID NO: 15068 - protein, 335 aa, Actinoplanes utahensis
MSSTGPGCAPPAPAATGPSPAEGDRAIPGTARHRAAYLRPMRDSQRKRRWRTALCATLIGLVPAQVALPAEPAQAFAPDLSFVPSPIPLGVQTHRSITEHAVTQALGSYFGVAEPTPRMRAAIEEIVAADKAVDDDQVSSDKHFDGENFDGGQRFVLANRAALLAALTAGDGAAARGRLGTALHPIQDFYAHSNWVELGNRGPDPDLGVPGRVIGPVAGILENTCTLGGILITTKLTSGYYGGEDRVPLVLASKCRHGGPLDSGPGSGGISKDFPVSILSPHPGLHQVAAQVAEQATRKFLDEIRAAVPAWQSQLLLGADLTFGPAGASRSTRPA

SEQ ID NO: 15069 - protein, 165 aa, Actinoplanes utahensis
MAAGAGGAQPGPVDDIREYARSLIATNLYLTLGTADADGLPWTSPVYFAPGDALHEFYWVSATDARHSLNLAVRPQASLVVFDSTVEPYRGRALYAEGTTAPATNLNHYPRSGARVSAEDVSGASPYRMYLLTATAMWVLCAREPGLPCALHGRAEDHRTPVPLG

SEQ ID NO: 15070 - protein, 348 aa, Actinoplanes utahensis
MNASSTEPLPPWWKKVHDTAQLLASQLNAAVGQASRDGVYTPPPGSPPPRRRRQAASLRHLAEVIRTHRLAPGMSVDKDDIAAVLAGDPRRITDPVLVIAVARAAHQIADLPFTDDDADRLRVASAHVAALTDVARQADEKAPRTVPARLKPVEPPVIDAYFTTRRPRRRWPLVATASGSVLLAGIGTFLVLGDRKSEKPSPPSATETRPAPVAADAECRLGATDDDIIANTPALFDDDRATRLSPTLDFDQMNGSARYARHDGRTYYWGRAGSDDQDPHAGGARIRWSTPDGRWRSCASALATTERGYVHTPAVATTIGGQPITVQICLWRDEPRRENCTQQISNGR

SEQ ID NO: 15071 - protein, 706 aa, Actinoplanes utahensis
MIPRVLAAAVVVTALVTVAACSAEPAGRAPAPDAGPVMEDVSASPIGVPKVSGDGSIADTLPAADRPTKNPDQAGGLAGRAVPTNQWWSSALTGPRTQPIWTHPLAVRAADVGVQISGAPVTASANAVTTPFLPALTVGAATGAVQVAGYGAFHVVLRVGLAGGGSVDATLVQGSPVVWLRFQGATPSLTGAFRDVGSTASRVRLDIAGGRWDVIGDGLGLSGATVTGSGENLAVARVPDGSDRASWERASTADPVVQTTAAMDYDAAAGTVTQTLTARRAGGGAGVWALLPHQQSGLLAGPAAVAGSYPDARGTMSLVSADTVRVRVPMPGLLTAVPQVPLNAAASRAVRDDLGRDLADPGGAGGSYFGLKELGRLATIAEVAAAVGAKAERTAALARLRPLLIDWLTCSGPSDGRYFGYDGTWGGLIAVPAEFGAQDYNDHHFQYGYLVRAASVLASADPLFARDYGDVIDLIVRDYAGSLAIGPASGLPPFRAFNAYLGSSAASGFAPFADGNNQESSSEAVAAWEAVARWGLVRGDKAMTGYGVTHYAMEAATARMYWLGAGLTRPPGYAHTTAGIVWDAKIDYATWFDPKPESVLGIQLLPLTAGSFYRGPSEARQRELGARPSVWGDLFAADLALSDPAAARRRLDAGVSREDSTSRAMVRYWVEALAVLGPPQPGVPAPLGSLAFGSTGNSRVVRPPAG

SEQ ID NO: 15072 - protein, 257 aa, Actinoplanes utahensis
MSTTIEKTGIDPHPVPSEAEPPGPAPAPPRKRWRAVLRFVRTLAVVLILLASAVAGGTRIVRQRYAERNMLDAGTAVLAAQPITVGSPDASVVNRVLIADRDSVTAGAPVVTITHTAAGGGPRVQQLKAPAAGIVTEINIAPGQIARAGEPIVTLYDPSQLTFRVDVPLETLRELRLGMTAYVSGPGLPGRIATMLEEVEPKVGSGGATAPSDLLTVVLRPDPAALPTVRTLVPGLRFHAVVDTTTAVGATPAVNSA

SEQ ID NO: 15073 - protein, 547 aa, Actinoplanes utahensis
MTAPPVPSAGPGTRLAWRKLQRSTRVAIIAALAATVFYQLFLLNPAYRGPTWLWVAMLAAEGLTALHLVGTWWTILAHDDQPEPVDVVVWRNRLRAGADVPAIDVFVTAYGEDPALVRATVLAARDMDLPHRTFLLDDGDSDALQRIAGQAGIGYLRRPGGAHAKAGNVNAGLARTDGEFVVIFDADHVPERNFLLSILPHFQDPDVAFVQSPQSYTNNVNLVATGSGEAQRIFYELVCPGKNHFNAAFCVGTNVMFRRAALDGIGGIWTGSNSEDIWTSIELHKRGWKSIYVPQVLARGLAPQDVPSYLKQQMRWASGGFEVLLRGRLLKRGSGLTIDQRLQYLFCGTHYLLSLAMLTFMFFPSLYLLFALSPIRADGFAWATHYLPFQAAVLLVTWLQSGGFKLSAIVASIGAVPVHLRALVGVLLGRPAKWKATNAGGDDARSLWAVMPLVALLLLNATAIVVGVLVMADPAPTWLSVGWASMIVLILGRMIIESVTGGRIRRRFTTPAMPGVGTHPPVTRELPASPRTGLESDSEPQPVPATA

SEQ ID NO: 15074 - protein, 46 aa, Actinoplanes utahensis
MHEVVVAAATVRTRHDDRVRALPPMGAPTFARCEAGTLPTGYFIHR

SEQ ID NO: 15075 - protein, 221 aa, Actinoplanes utahensis
MFEDTPVTPPGDPSPDTGRRVGATPAPRRVVSGDVRHRIHLSRRYRLIATGLAAGAAGIVSGVSLVGLLRPTTDPAEVHAGAASVAVTNPGWYPPRPQIPVSVEPSPTRASLPPSRRPPASPAPTAVPATVTILPADHERDLRSVESDRETEIRFVNRRDEPIVINWLDYRGKRENYGILAAGGVREQVTYVNHPWVITDLRGRALAILLPDTRPAQATIT

SEQ ID NO: 15076 - protein, 181 aa, Actinoplanes utahensis
MVPLSELLRRNRHFAAHADLTRLTLPTALPDRLLLILTCLDPRVEPAGFLGLGPGEAAVLRNAGGRVDERVTQDIALLALRFGVRMDVAIIQHTQCGTGLLADPAFRRDVADRTGAGDAELTAKAVTDPVATVRQDVARLLAHPLAADGLVVSVSGHAFRLETGLVETVVDAVAPAGRHAA

SEQ ID NO: 15077 - protein, 370 aa, Actinoplanes utahensis
MKHAALAAVVILAGAAVGVAGRGPARAAASTCDVTWTANSWSTGFTADVKVTNLGAAVTSWTLGWDFAGGQKVTSAWNATVTQSGTTVTAASVGWNGPLPTGATTSFGFQGTYSGTNTAPSTFRFNGVTCGAEPTPPVTPSASTSTVPGTCGTRCDGFENKLANWTVTTQDCSGAGTAAIDTTVAHSGTASLRINGAAGYCNHVFARNTSLLAGTGNVWYVRYWVRHTTALPAAHVTAVAMADANDGGRDLRFGGQNGALQFNRASDDATLPEQSPAGVALSRALPTGTWNCVEFKVDGSTGTIETWLNGTSVPGLLEDGVATHDVDGQWLDRTWRPALTDLRLGWEAYGEGADTLWYDDVAVSSARNGC

SEQ ID NO: 15078 - protein, 533 aa, Actinoplanes utahensis
MKTRMWLAGATALAAAAAMAAVVTAQPAVAAGGGTGTGYLHTSGNKIVDSTGATVRLTGINWFGMETDNKTFHGLWSSNPWKSQIDTMASLGYNTLRVPFSDDSLKAGATATGINDNTNPDLVGLSPLQILDRVVAYAGTKGMRIILDRHRPTSAGQTALWYTAAVPETTWIADWKSLAQRYAGNPTVIGADLHNEPHAEGTNPAATGACWGCGDTARDWRLAAERAGNAILGVQPNWLIFVEGVSCPSGGLSNVWDNDPGNDEDCGWWGGNLSKAGDFPVRLSVANRLVYSPHEYATSVYHQAWFDDPSYPANMPAIWDHYWGYLYKQNLAPIMMGEFGTTLASTIDRIWLQELLKYTGTGVNGMSFTYWSWNPNSGDTGGIANDDWTTINQAKQAILQPYLIAPIGGGNGGTGSPSPSASSSSSTPVPGWSCKVTYTQDNAWQGGFQGQVKVQNTGTGTVSPWQVTWTWPSGVTLVNGWNATVVQSGTTVTAAAPSYASSLAAGASVSVGFTANGTASAPATVKLNGVACS

SEQ ID NO: 15079 - protein, 185 aa, Actinoplanes utahensis
MDLYGTEPEGVESEGMGAAPSVAKLLLELRGRTTVDVKPVGRSIQIRPQGARNVAVHIHPGGVDIAVARNQADEVAATIFGATVKDPDDPVPFVSVEGHLIDTNYDAILAASVQAVELRKAGGPAKAPRAAASGGSGTPRAASTRSAAPKATKSTRPAPRPDRPICPRCKQYELLASGECPSGYC

SEQ ID NO: 15080 - protein, 262 aa, Actinoplanes utahensis
MGSTLGAARGRVLYESAMGYIEWAPPPSLRGVVACLWRSTLPERPSRVPMPILPDGCVDLIWQSGHGAFLAGPDTRPVPNEGRAGREIVGVRLRPGAGGTVLGMPLEPLQNLRPGLGEVVPGLVVPAEVRAGEALRRLIVATGRLARENPVDPAMLAAARMLRDPRIRVDEVAVEVGLSDRQLRRRFTAAVGYGPKTLQRIYRFRRYLAMVGEGSAGELAVRAGYTDQAHLSRETVEFAGLPPAALARRMRRDQGSVGAGFR

SEQ ID NO: 15081 - protein, 287 aa, Actinoplanes utahensis
MSADFAAADRFLQAEGRLLDRRLFATLFRGASPDGVVDALRGYRNADGGFGHGLEPDKRCPASLPIDVEVAFQALAAAGVADPGLLGPACDFLTTVTKDGAVPLAFPVIEDHPRAAHWTDWTYEPGVNPTAGLAGLLHQLGFAHPWLDTATSYCWTVIESGRLPEETHALSELLVFLTHVPDRPRAERSAESVLAAITGSELFQTEPRIGAYGLTPLHVAPTAGSPWRALFEDAQLDAHLEALAAAQQDDGGWPVTWEPPSAAALLDWRGHVTLQAVRTLTSYGKPG

SEQ ID NO: 15082 - protein, 390 aa, Actinoplanes utahensis
MHAPMGAVRRLMDLRHRGRAEDLPGVLTAAAPLLDARAAIVLLVDYAQRELHPLRGTTPVAPQAVEGTPAGRAFTTGDQQWSPEPDGGGVLWLPLLHGAERLGVLALRFTTYPVIDLRDDLEVIAALVAELIASRRFYGDAVEQTRRRLPMQLAAEVIWNQLPPLTYAIDGTTVTAVLEPCYDVGGDAFDYAANGETLHVALFDTVGHGISASALTTLTLNTYRNARRSGLSLVDTCRSIDKWIRAQYPGAFVTALLAELDLASGVYRRISAGHPAELFFRGDRSRSPLPSPNTLPLGLGHMLTRPPRVVEQRLEPGDTLVFYTDGITEARDASGVLFGVDRLTAFFEDALRHRRPAPETMRRLIHTIVSYEEEELRDDATAAMLRWRTT

SEQ ID NO: 15083 - protein, 262 aa, Actinoplanes utahensis
MVPGDLQTDRPHSARIYDFLLGGKDNFEADRRAAAQMLEHTPALPISMAANRRWMARVGRYLAGRGIRQFLDVGTGLPTRPNLHEVVQTEAPEASIVYVDNDPLVLAHARALLTPIGTGSVSYLDADLRRPDTILGSAAVRDGFDLNRPVAVTLIAVLQHVTDDDQVRDILAQLTAPLPAGSAVALSVVTVDNDAAGEGTVRTYNQNGVPVVARPRAAVERLFAGFDLVEPGVVPVHHWHPADEDRAVSDADVYMLGGVAFT

SEQ ID NO: 15084 - protein, 450 aa, Actinoplanes utahensis
MAHRRSRTDPVLGAVTIAVRPETDPALWVLLDRYPIGSTGQPQALVGDLMTQTRLNMPGTFVHEWAHVLQAAAYPMLYLRASREWRMVRTTWNYLAAHPGRYPLPIGIQWDADIRRARQVETAPARIEIRGRSVQVVPASFDKFERGVLVDNDLLEEDASIFQYRVERGGWGSGTDYQRWVNERCSYSAVFSFLRRYLPIDTAYALIPIAARVAYRTTDPLTALAIMVGSSLHEGDKHIDEENEDFWEFLMAMSVDRLLSPAADEAVGWTRHADVDAALITSQQMRRAVDAGSFLPINHLARRNVSDASVEKVLRRPWEHIAPNGGADECATSLLPPATVFELADPARLAISLHRSFAQLHPVAGAEFTFADVYPTMLQQKLMFDVQVGGRSALRVCPHQTCRVHGTDLCEGYFPVPREPEDCGFPDLFRMLTGMTVSSDGATLEPVQEG

SEQ ID NO: 15085 - protein, 117 aa, Actinoplanes utahensis
MELLIEGDPQTLHILRREIDDRIGAAAELEPRYDRTVGTLNEPILIALIVALGGKEIILAVRDIINRRYEHLERIEATRYAADLTLTLRDQRGDRVVSVDELIGEARDGQPSADIRP

SEQ ID NO: 15086 - protein, 169 aa, Actinoplanes utahensis
MGSRLPTYDRRQVYVEVDPDTAHDPSRLAWHFRSASLATADWAGCTVFIFPDLEREDLPIFLDERVRTFYRKLCDDVPFLLYFLDPEPGTGTLLSVLCAHARDDQIAQRHGMVEIDPDERLRDRCARLVADAAVYADRLGDDWPAFVDELPLPDDFRTRALRMCQGRIP

SEQ ID NO: 15087 - protein, 162 aa, Actinoplanes utahensis
MGFFGTVMLIRADVDLETLPAVVALGGTLDAAWTGEHGWRFARVYDGKSFLPAGVRAVAEQTGAPFLAAYVVDSDFAIVQCAAPSLPEIQFVLNPACAADYDYPVDPAVQEAAVRYLLDFAGGRGDAARIRAVVEDDLTFAEEAVPRLAAALGAGSVEDPDR

SEQ ID NO: 15088 - protein, 250 aa, Actinoplanes utahensis
MGALPITACLIFQRLGHLAAMPDTVKARRGEARLPSAAVVVVAIALYALLPEQLIIGPRLVIPALEVMLLIALLVVNPYRMTRDSPWERVAALTLVALIAVANAVALVLLLRQLVTTDDSQSVELLIAAGQVWLTNVIVYGLAFWELDRGGPVARTHVARDRLPRADFRFPQDEDHDTIDEVQAGSSKVSDWVPAIVDYLYVSLSNSSAFSPTDTMPLSTRAKILMGIESTSALVISVLVIAKGVGGLGH

SEQ ID NO: 15089 - protein, 91 aa, Actinoplanes utahensis
MTTERNFADAETLTPVMREVFGTRRRITAVDRLPNGTKTGVYRVTMDDLTSAIAYIWNAEEDYWDGLLTDGHDDPSNPFAHAPRLRGEVTC

SEQ ID NO: 15090 - protein, 127 aa, Actinoplanes utahensis
MQRFERPAGLPPVNGYSHVVAFSGTMVAVSGQVPLDGNGQLVGLDDPAQQMRQVFHNLGVALAAAGSGFERIVKLTVFLTDMADLDVFREVRDEYLDGAALPASSLVQVAALINPAFRVEIDALALA

SEQ ID NO: 15091 - protein, 433 aa, Actinoplanes utahensis
MRRFNGRLRSATIIGLQGIRARKLRTLLSMVSLFLGVLAVVVVQAGAGIAERLQLADLELQSGIDGTKVIYGVPPAAGAAEAVASTVKGRTDAVAMFNVTAIIGEPGVRPVNEGGGSFDQDYSGGGAVTICDTPTHCYDPNAGAPKGQAIELRISALTGDVRTFRPYRHRSGRWLDFTSQPMLAPGLVLNEEAAKGLDRYHVPAEMRVSGATANMTPRILGVIKDGDSQPHAYVRLDELTSWLPLARLSDPNGGNVDSQVLLAAATPVEPVLLTKLKALSGNDVTAETINSRKEMKEQLNLLRMIFLAMASLVLIIGAAGVLNVGLATVGERVEEFALRRAVGTPRAVLAGIVLAETLLTGLLTAALAIGFSIAALKVGTIVLGPSEPFLQSVVFPWSAGVSGIIAGLAAGILGGFIPAIRAAGIPIATVMRA

SEQ ID NO: 15092 - protein, 229 aa, Actinoplanes utahensis
MTALIELTGITKVLKGQKEPRTILDGVDLTVHPGESVAIVGRSGSGKSTLLSVLGLFDRPDSGTYLLDGQDISRLKERHAARLRSSHYGFVFQRFFLLKHLTAAQNVAMALVNGQGWQPRRERRARVMQALEQVGIAHLAKNRPAKMSGGEQQRVAIARALVREPRVLLADEPTGALDLETGTIVIDALQEATGRGCALILVTHDRDHAARMGRTLDLRNGVLNDRVLT

SEQ ID NO: 15093 - protein, 142 aa, Actinoplanes utahensis
MPEPVVAATTPAAQNPSAPAAPDRGTAGGATGGSEATGMRLVCVPPAGVKLINGADVTIEVVTDRASKVLVLPVEAVAGAQGRGKVDLVVGDGQTRKTIDVTLGISDGKVIEIKKGLTGDETVAVPGPNLPTVAPTGGGTNG

SEQ ID NO: 15094 - protein, 407 aa, Actinoplanes utahensis
MLRVAVVPHAGHPERVLGRRPGRGPAGEPQLPVDRRDQAEDRVDRHLAGQAEPVRQILPDGFDRGQDRATVGEPGGFGGIVRGGAASGRQDHHQAQEGMPAKNHRIPRRQCIQQRGEGYRTGATPAAGCHHGRMMLLVPGDPVRPRRPDGHFAAEAAAAPAFAVVDHDALAAGGDADAAVSRVPAAADAVYRGWMLSAPHYAAMAAALCRRGVTLRTSPGDYQRAHELPGWYAVVAGHTPETVWTDADIAPACAALGGGAAVLRDYTKSMKHYWHEAAYVPDVTDVEAARRVAARFRELRDDAFTGGLVLRRFEPFRGAEVRTWWLRGSCRLVTAHPDTPDELPPDDLDPGFLAPAMRTLALPFVTADLARHADGRWRLVEIGDGQVSDRPATTPPARLIDLLATAS

SEQ ID NO: 15095 - protein, 304 aa, Actinoplanes utahensis
MSEYRAEDIVVLEFPEAVQRRPGMYFGVGRGDPRLPSEVVRTVAGAAFHPAPPGVEHRPDVVVEILGDLVFSVTVRSVTALPDGTARGCQGCLLTAPLMWWAAAAAVSVSAVVETWADGRALREELRHGRPAGPPQPRPAPEGRGLRVTYHLDPELLAPGAAIATEPASLDPYGPYCAAHRGPGQVTLHDRRAPGTPAVRWPGDRSAIGLAADQDGDDGDQQQGEREAAAGAQRDVHAGEHGGQDEHGGRAEPDREAAVVLGDPGIAGDPARPRGDGVAREVEERPAQAGEGADDGIAGQVKKA

SEQ ID NO: 15096 - protein, 101 aa, Actinoplanes utahensis
MISRLLYLAGNTIVGALAGLGWPFLYLAGYAVAARAGWITGDPRITEDYGSFAIRLGATTMLVLTAMFAGVNIPLRARGRLPFALLLVTIVAVLVSRQTYR

SEQ ID NO: 15097 - protein, 294 aa, Actinoplanes utahensis
MELRLLRYFVATAEAGTVSAAAVRLHLTQPALSRQLRLLERALGVALFDRTGRRLDLSTTGRALLPLARDVLTRVDALRVAAAVAASGRLERLTIGAPTVTLTDVVSPFIATLAPEDPNADVLDADGLSPVETLRLGADLAIGTVRAADPFRSLPLAVLPVWAYVTTDHPWSGRPAVTLTELLTATLIVQPPAFTARQSLESAVAAAGATYTSSIETANGTVAQALAAAGRGVAVASDDPRFGLVPLPVDVGGRRLSIRLAAVWDSRHAAAPTLESFAARLGAFIRARYSAPAD

SEQ ID NO: 15098 - protein, 446 aa, Actinoplanes utahensis
MNRLCRVSLEQKRRLVTALPGPRSQELMERKLAAVAGGVGTTMPVFAARAGGGIVVDVDGNHLIDLGSGIAVTTVGAGAPRVVAAVTEQVAAFTHTCFMVTPYDGYVAVAEALNRVTPGDHEKRSVLFNSGAEAVENAVKIARAHTGRDAVVVFDHAYHGRTNLTMAMTAKSMPYKHGFGPFAPEVYRAPGSYPYRDAGVDGRAAAARAIDQIEKQIGADNLAALVIEPIQGEGGFIEPAAGFLPALAAWCRANGVVFVADEVQTGFARTGDMFACDREGVVPDLIVTAKGIAGGLPLSAVTGRAEIMDAPHAGGLGGTYGGNPIACAAALAAIETIEQDGLLARAREIETRVTGRLHDIRDKDDRLGDIRGRGAMIAVELVRAGGREADPRLARDVARYAHQRGVIVLTCGTYGNVLRFLPPLSITNELLDDAFDVLAAAFQEIR

SEQ ID NO: 15099 - protein, 459 aa, Actinoplanes utahensis
MSIVVVDPASLRAVAEVPDQGVEDARAAVDAAYAAFPAWARTAPRHRSEILRRAYELMLRDRERLAALIAEENGKSLSDAAGEVTYAAEFFRWFAEEAVRPGGEYGEAPAGGARTLVTHRPVGVAALVTPWNFPAAMITRKVGPALAAGCTAVIKPAAETPLTALALAGLLTEAGVPDGVVTVVTTSDASGVVGAWLNDQRVRKISFTGSTAVGRVLLRHAADRVVNSSMELGGNAPFIVTEDADLDAAVAGAMIAKFRNGGQACTAANRFYVHAAVAGEFVARFGAAVEKLTVGAAADGADIGPLISAQALRRVTRTVAAAVESGARIAHRAATPSLPGHFYPPTILVDVAPDAEILHDEIFGPVAPIVTWTDEARMVAQVNAAEYGLAAYVFSGDLARAIRIGESIEAGMVGINRGLVSDPSAPFGGVKQSGLGREGAREGLREFQETHYLSVAWPA

SEQ ID NO: 15100 - protein, 302 aa, Actinoplanes utahensis
MESGDLIAGRYRLERRLGQGGSAVVWRAVDELLGRGVALKVLAPALAADPDLRRQVAAEARAAARLRHVNVVGIHDCGELEDAGGRLPYVVMELVDGQSLDDMLRRGRLTWRQAVLIGAQVAAALAAAHADGIVHRDVKPANVMVTGAGVKLVDFGISAAVGALDGQDGRLMGTPAYLAPERVKGGPVRPATDVYALGLLLYLALAGQMPWEASTVTQMVKANVYAVPAPLPAVPGLPPVVARLVTRCLAKRPADRPSSAEAAHVLGEIAGLPSPALLRGAVAPTAELPVRPGRGRRGVLVA

SEQ ID NO: 15101 - protein, 132 aa, Actinoplanes utahensis
MTGGRDAKLVLDTSAIAAWVRGSVAVGETLAEVNDEDGAVVIPLSCLVEAGYHTAVLGRERLELLLAHPATSLITDDAEDWDALVALRALTGRADCASAAMLALDLGVDVMTSDPSWYKGVADGRIVLHVED

SEQ ID NO: 15102 - protein, 205 aa, Actinoplanes utahensis
MGQPTLRTDRLLLVPLADRHFELEVGLDADAEVLRYIWGRARTRDEVVTSHAERMALATRVNGLGHWMAFGTDGGRRGSTAPDGEADGEFIGLMMLPPAHGDDQPDDPTVAELGYRLARRYWRLGLASEASRALLRHAFDTVGQSRVIAQTMAVNTGSRGVMETVGMRYVRTFHTSWDDPLPGTEAGEVEYEMTRAMWESHRGTL

SEQ ID NO: 15103 - protein, 350 aa, Actinoplanes utahensis
MRSALISGASVAGPALAWFLRRDGWQVTVVERAPALRDSGYSVDFRGDALGVLAELGVLDEVRTHETGTLGTTLLDPTGQPVGELPPEAFGGDLEVPKVALTRILHRIADVAYLFDDTVTALTQHDDRVAVTFERAPARDFDLVFGADGLRSAVRRLAFPGVDPVEHLGMSGGAFSTDDYLQLDRRGLLQAGPGRAIYLFPAIDPGRMWVSLSFATGNPEFDRFDRPVHEGALRGVFATHPWAEVPRLLDAMSAADDFYFASTAQVHLDSWSTGRVALLGDAGYCAAPTSGMGTSQALIAASTLARCLAEAGDDHATAFQRYETELRPYVTANQKAGRAAIPGFGGADVE

SEQ ID NO: 15104 - protein, 163 aa, Actinoplanes utahensis
MGNREALIEGAKRCLTERGWARTTVRDIAFTAGVNHAAIGYHFGSRESLLVHALVEAVEELSETVATQAQDSSAEARWQALIDTFGTHRALWIAQLEAAVQAEHSPELRERLAAAQRQGREGLGGSVPLALLSGLMLQWLVDPDEAPDGAQVVSELRAQAAEV

SEQ ID NO: 15105 - protein, 275 aa, Actinoplanes utahensis
MPDVRRLIATALPDYRVESVSVLGQGLDNVAYEINGDLIVRLSKTPDASRTVREARLLTEVRRFAPLPVPEPVLTLAEQGCLAYRKLPGVPLLDLPAAGQPERIIAALRDFLAALHAIAPERLAGLADADEQAPSEWLEEAAETYAFISHRIPASYRPRVDAFLSAEPPPAGDTLVFSHNDLGIEHVLIDPATSQVTGIIDWSDAALVDPAHDPGRLYRDLGPAALPADQSPAVHDRAIFYARCGVLEDFAYGVETGRTRYTEKSLNALAWLFPP

SEQ ID NO: 15106 - protein, 321 aa, Actinoplanes utahensis
MDALAGRLAAETDIRTLQMGQYSGYLDDPSEPAVTRHGLQPDGRFHPGDVLVDLPAGEPIGDVGYQNCVPAAMALLAQAWYAAGKEQYNPTLEDTLRIYEKVSPFRRDPAGAAVASNAAGRAANEADRSAQRPTPAQPISKHREAHNDFGTSLLLALKVWVHKDQPLAGLLPEARSFLEIEPRNLDQLREAVLRFGGVLLGLALPQSIKDAQGTLRESWYVPGYGPVYDATAGSLSSHCVAITGFSQREFFCLSAGRVRRLSPEFVLTYADEAYTVTPPAALDANPGLRDRISRDVDDIRRSDRPAGMPAFNHRWRGGNIM

SEQ ID NO: 15107 - protein, 974 aa, Actinoplanes utahensis
MAGLKGFVGRAAELADLAGALGDAVRGDPRTVLIAGEAGVGKTRLLEEFEERCAGRELLLARGACVSVGAGELPYSPWLAAMRAVEAEALAEVPGAEQAALSALIPALPDPGSPREGGQLARAHLFSLFLEFLGRLAAKRPLVVLLEDLHWADTSSLDLLLFLSRNLRRAAVLLVGTFRTDELEEDSRHRVVFGELIRGRSTTYREMSRFGESELADLLRVSAPISDAVISKVYQRSGGNAFLAQEILAAEQRNPGGPVPDHLRDLLMMRVEGLSEEGQRIVGVLAAAGRPVSGALLEAASGLPGPALRSGLRDAVARQVLVRTPEESYQLRHSLTAETYYQDLLPGERAGLHLAVAGALAASAGPETSAIVQAELAHHWFQGRKDDDALFWTLRAARSAALVHAYAEARRQYGRVLDLWRRVPEAAELCETTYPRLLDEAAEVLDYAGDPQRAVQLTGEAIQVVGAGGDRQELARLYEHLARLRWRANDTPGAVASARTCMSLADAGLKARAGATYARVLMLSGHYRQALDEASAALAVAADPVERGYLLVTLGTVRFLLGERDQGVAQLREGLALAESTDSKENILRAYTNLTYCLQMLNRLEEGLALARRGCELAAGFGLRMTTGVVLVGNAADILLDLGRWEEIERLIGEVLPDEAADDLPLYIQYVRAEVFVARDERRAARDILDLVMSRSAGKTDQDFVGHAYAALAALEIADGNWRAARRAVDEGLAKLGGGEGAFPVLRLAVSGLQAAGEAADQARRADPDGVHRWVTWGDMLAGRAGEALEELRRAGGGQALPVAEALHAVAQAEALRVRGEAQEAAWTAVAATWQALGHPYPEAQARLRLAACLLRRGATSALHREITAGARLAAGLGARRLSRELAELATLSGVVIRSEPVPEAAPRNDWGLTRREGQVLDLIALGYTNARIARSLDIAEKTVSVHVSNVLAKLGAANRWEAALIRRGEPRPE

SEQ ID NO: 15108 - protein, 476 aa, Actinoplanes utahensis
MTVIAQRPAATATRHAAKANAPHPLAETVARGAVANVPCAATEVVAGGAAGDVARAAAAGGSARLLAGGQARESVGEIARRPTEEILEHLSTVARGGNGHAAAAAALELAAEVAWSGRRRLLTLAAADAQLAGERQRAGELLRRAAETGESLPAPLVGMALVAARKAMAQGRHRAAERGLAGVAAGMWQSGAIRRLPTVLALRSWALARAGDLGAAESEADRAVTLAALTGDQGATVQAGHTRTLITVLRGGPAPASGGDPLGAGLALLGALAGRDPAEAVEVAAEHLPDLLECRLIRDRALSRDDLSTLHGLTRSTAGPIAANAWRVLGLTSRDSADDCFAQATRLHRAMDLPFDNARVHLSYGERLRRDGDRRAARNQLRIARDTFADLRATPWVARAERELKGTDESRVPAGLTPAEFEVARIVATGVSTRETAARLFLSPKTVEFHLSKVFRKLGVSSRAQLAHVFPELSCP

SEQ ID NO: 15109 - protein, 74 aa, Actinoplanes utahensis
MARADALFVSGLPTGSHPGRDEVDATVRAMVRCYRGSRGCAGEVAACYGEIPEYAVRRMAWARWVIASVFGGAR

SEQ ID NO: 15110 - protein, 136 aa, Actinoplanes utahensis
MPDTDADHAELTTLVQIFFDAFVSGPESPARLDTLRTVLLPEAVIARTTPELAVYTVDSFIEPRRTLLTSGRLTDFHEWPGSGHTEVIGDLAQHRCAYAKSGILDGTPFTAEGTKTFQFVRTPAGWRILAVAWQDH

SEQ ID NO: 15111 - protein, 267 aa, Actinoplanes utahensis
MTPRRDPPAAPCRDARSSRDQPDPVGIAAQSRSIMPATTARTAALSAIAATTLWVSPTAAQAHPVLPKPPAVTTVSTADSVSTANSMSAVIGLGQIRLSGPNVAGDPVWFGIEAFTDRTGSAHGRFRFRHERPDGTVVGDGWAEVTCLRVTGDVALLTAVVPDGVGVVKNHAYYMKVTDGGSQPDQLAFVQAQNGTERPPTRCVDFDVEHPGLADRSPVYTGGFTILTSRITPEGSAGSTTAPANSRTTSGTGRSDSGGIGSVGGIR

SEQ ID NO: 15112 - protein, 423 aa, Actinoplanes utahensis
MTITCHAAPKLTGVGVWRRWAATWPAWAGYAAAGWSAAYATLGLYWTFGGNGFPFAPIDEAHVSGSILEGTPVTDGAPVMAVIGLLGTAAAWAMARGVGISGRATGRSTPRPPGRARPAVRPLARASRPSGRDVGAGTGVGTRALALIAGGWIVAAGLTLIIPDYTMIALVAFAPLLLVFSFTGVPGEQNGIGDILYWHRTNLIIIFLGGVLWAAATLAYQRRARGACLHCGRHPDAGGGRSREDMLRWGRRAVAVAITAPLLYEITRVAWYFGYPLGITPDFLRMMQDTPGMLDVGLGCAIASTVGGVLTHGLVSSWGETYPRWLWFKKGRPVPPALAVVPASIVAVSIIPAGLMVLWTTEVRTTWALWVPSMLWLAWGVGLGAATITYHLRRRGACRHCGQGDGHPEPIASPSDRPEPSPH

SEQ ID NO: 15113 - protein, 98 aa, Actinoplanes utahensis
MTIERIAAMSRCSGEVPNEVGTPLQRTHAPICLPGAPGITPDPLELIRRDLATVAGGGPATVEAGVGTLDRRGSMTPAEGCASRPSASRNCSRGQCRG

SEQ ID NO: 15114 - protein, 311 aa, Actinoplanes utahensis
MPPTVVRMFGHTKRVLLPSIVLLTAACASPHPTLLPADVRSMAQGADGAAVLRLAETILVGRCMRNAGFEYPLDPAEARRELAATPPPASLESAWQDDDEKRAAAGPTSPPPESPQPRTDLDRYVEGLDPGRVQAFTTALYGDQTTGPWVRVEMPIGTVRQSRAGCQSDAQRRLYGDLDAYLRGRITQDNLNPIIQARVTGDAAFTAAEGRWRTCMAKEHWPVADQAELDTRVAKANENLPPEQQKERSRDAAVLSARCNRQTGLSATARRLIPVAERRVLADLSPQLTDLSRRQQAALPYARRLLDGEDA

SEQ ID NO: 15115 - protein, 132 aa, Actinoplanes utahensis
MKRTLAVALTFAGAAATIAVAASPAQAAPAQCPYRSFCVYNNQHYRNGVWSTPNNDNDWSDNLFSNRSDNVANHDSSWFNNGSAASPSFVRVYDRPGRTGGVTICLAHGTGFESKPASVSDHGESHEWANGC

SEQ ID NO: 15116 - protein, 375 aa, Actinoplanes utahensis
MTSPAPSTARISVIGAGPGGLTCARILQRHGLAVTVYDRDQRRDARNQGGTLDLHADDGQVALRAAGLLDDFFRLARAEGQEMRRLGIDGTLQEHHLPAPDELVKPEIDRGQLRDLLLDSLEPGTVQWGRALTSTDGRVLRFADGSTAETDLVIGADGAFSRVRPVVSPAVPHYSGVTFLEAWFDDVSERHPDLSDLVGQGGAHAADGTRALFAQRNSGDHIRVYIIRKAPVDWITAAGLTIADTAGIRARLLAEFADWSPRMLQMVTENDGVYVDRPIFALPVPHTWDPHPSVTLLGDAAHVMPPLGVGVNLAMLDASELALALASSPTVDEALRHYEATMLPRSTECAKLLENGAEQLLATDLHDFDEERLQS

SEQ ID NO: 15117 - protein, 207 aa, Actinoplanes utahensis
MDERPVGRRERKKAATRQALADAALRLFLEHGYDRVSIRDIAEVADVSTTTLFKHFPGKEALVFDQEEDRDAQLVAAIRDRPDGQSIPDALRRHVLDTYLPVVAHPLREDYTRLVDSTPALRDYSERMWTRHTETLAAAIADDLGVPHDNLECVTLARFVLDIPSLTRGRPDQEVAVETVFAIITDGWHARRPGSDAATPDQLAAES

SEQ ID NO: 15118 - protein, 752 aa, Actinoplanes utahensis
MIGWSAVVRHARAAAFLTGLLVLLFSVFTSVVTARDKQVATQDHALDLSLGQQVAAVRNYFDQARAIAEVFANNPVFIDFYQAPGTTREKIAAGGPLIGRVNDALAYLEQLYPGRIQSASFVDRDGRQIARVAGGVPVRAVNLRDNEQLRPYFAPTLQLGPERVYQTAAYRSLDTGDMVISDSTLLMANGFTGIVQFEVSLSSFRMPDTSGGRVASILGASSGEVLIDSRTTGVGDRTFAPIARAGALAGMTNLNGLRVAYQRMPATLNNANDWYVVVSDQAYGAGWNRGFPVRSLALVLAALLTILISGVSWRAHARSVRRAGTHDALTGLPNRTLYNERTQAALRGGRPAAAVIINLRGFRDVNDVLGHRHGDLLLTQVAQRLTAAVPEGATVARIGADDFAVLLPGADAATARATAEALLAGLHHTFVIDDFQLDVEANAGVAAAPEHGVDAETLLRHADAALHLAKEQVSGVQQYDAANDTGTASRLELLGDLRRAMGTDDQLDLHYQPKIDLRSGRVTGVEALIRWQHPKLGRMAPDMFIPMAESTSLIRPLTGHVLSMAVRQARIWADRGTPIPIAVNLSTRCLLDPGFAAQVFGLLYRTGLPAHLLKLEITESAAMADPDRALAVLRALHDGGISLSVDDFGTGHSSMTYLQRLPVDELKIDKSFVQAMADSPGDEMLVRTAITLGHNLGLSVVAEGVEDEAAVAALRELGCDIAQGYHYARPMPAGDFDRWFAEYCQKAAAPVA

SEQ ID NO: 15119 - protein, 599 aa, Actinoplanes utahensis
MTLTLLASDGGVVTLRPARPGDRTGMLRFRLAAAATDRIILVACAGPPPPDAAKDHAAEKDAANDHAAEKDAANDHATAKDAANDHATQKDAAKKAERAERAEQATARKGAPPVIGVAAYARLDPAGRTAEIAVHVAPHHRGRGIATLLVEQLTAHARQAGITELIGPGPDGGTELRPMLTPASVVVIGAGPRHGGAGHETLRALRDYGFAGRLYAVNPAGRPVCGVPAYRSVSDLPEPADLAVVAVRADLVPAALKEAGRCGVRCAVVLSKGFASSGPVSRQRRAEVLQVAREQGVRLLGPSSIGVLNTGPDARLNACLSPERPPAGGLALAAQSGPVGIALLAGAARGGCGVASFVSLGEGLDVTENDLVTHWFDDPATRAVGLCLESVRDPAGFATLVRALGRRKPVLAVSRAGALLESAGVICTTGIGEMLDTARMLIGQPAPAGARMAIVGNGGGLTGQAADLAEAAGFTLLPLTSATRRQVARGRDNPVDLGIDATPASIAAAAETVANSGEADTLLLIIVGTRANCPIAIMTALGEVVDGHPDVTIAAVLTGGNDGIQTFGSRAAPVYPDAARAVRALAYAHRYAVWRNTDT

SEQ ID NO: 15120 - protein, 193 aa, Actinoplanes utahensis
MAYRPRMEVDSERDVVALIESDPAAMRVLHAAATLALPDWWIGAGFVRNRVWDAITGRPPSPERDVDLAYYAPDSVDPADDARAEAHAAELLPGVPWEIRNQARMHLRNGDAPYTSTLDAIAHWVETATCAAVTLRAGTVHLAACHGLTDLTTMVVRPAPSFDNAAGHAAVRARVEAKGWLRRWPTLRLELGR

SEQ ID NO: 15121 - protein, 105 aa, Actinoplanes utahensis
MAGCAGRPAAGPGSGASPTGRHRAIGPGRRWTASVTIAIEIGDGHQQARAHTGLGHVHHAVGDLARARRHYRHALTLCAHLGLPGAEQIRSHLAAVGSAVAVPGC

SEQ ID NO: 15122 - protein, 331 aa, Actinoplanes utahensis
MLIGDVARRTGVSARMLRHYDTLGLVRPTGRTHGGYREYTADDLRRILYVEGLRTLGLSLRQIGRTLDDPGFTPAALVGDLIRRTEERLAADRELLDRLHAVDVSEPAGWPDVARIVGLLHGLDSPDAARRQQAVLAPAAVPADLLARAVLSESDPNVAGALRWALARAGADGIAGLAAGAASADADVRRRALQAVAGLPGDEAVALLTEALSDTDAAVRRQAARALGVRGVPAAVPTLIAMVVDGPNDVEAGELLGALAADPTLAAPILAALTAELAAPDTGPAARLRLTQALAELPGSLAHDLLRDLSTDGDRPVSLLATALLSRSDRQ

SEQ ID NO: 15123 - protein, 221 aa, Actinoplanes utahensis
MTETNASARLQAVLAIGTNPDPDDLEMLMARCAAEPDFFVRDMLTWALTRLPPEVTVPRLCAELGSEVAQARSQALHTLSKIGDRSAWPSITPALLHDVDDEVARAAWRVAATLAPERERAALAVELTAELGRGDREVRMSLSRSLVALGTVIEPVLRAAGDNHDPEVRTHALATEQLLRDPQAGFRPRRTRGDQDRRAGPPCLPAEVTGDRARLGRAPSC

SEQ ID NO: 15124 - protein, 278 aa, Actinoplanes utahensis
MKRALVLGGGGVTGIAWHLGLLCGLQRAGLPLGDADTIIGTSAGSVVGTLLAAGVDLEAAVAAQQVEAAAPPRSGGSGRGTSQWLAAMSVLIDPSVPAQQARAQVGTMASAADTTDEQTWLRRIGDLLPIRDWPQGRDLRLVVVDTADGRDVVLDAAAGAPLLQAVAASCAVPGLMPPVTIGEHRFMDGGVRLGAGADLAAGADRLIVIAPMAMLGRERIEAEMAAAGAAGSLLIEPDQEALEAFGPNFMDPARRAPSVAAGLRQAEELADAVRGVWR

SEQ ID NO: 15125 - protein, 464 aa, Actinoplanes utahensis
MRRSVILAAAAAVAAACSTVYVAATASAAVACAPVWSASVAYVKDNVVSKGGSNYTAKWWTQGEDPVVKSGQWDVWINNGACGGTTNPSPSPSVTSKSPSPSTSPSPSGSPSTSPTTPIPAGNLPKHALVGYLHTSFANGSGYLRMADVPSDWDVIDLAFGEPTSVTSGDIRFSLCPVSECPGVESEAEFVAAIKAKRAAGKKVLLSIGGANGQVQLTTTAARDTFVSSVSAIIDRYGLDGVDIDFEGHSLSLNTGDTDFKNPTTPVIVNLISALKSLKARYGAGFVLTMAPETFFVQLGYQYYGSGPWGGQDPRAGSYLPVIYAVRDFLTILHVQDYNSGSIMGLDNQYHSMGGADFHIAMTDMLMAGFPVAGNTANLFPALREDQIGFGAPSSTNAGNGYVAPAAIQQAVTCLVKGADCGGYTPRSGLNPDFRGLMTWSINWDRFSSWEFRNSHKPFLTALG

SEQ ID NO: 15126 - protein, 213 aa, Actinoplanes utahensis
MGGILRSDFVGSAERATRRGVNTGESQGGVYIAGNVSDLYITYPEGYNPAQEVLAQQLARSAEGLRRQEAILREIYTLGLVQARLSFNLSMSFAGIGAILLFCGVGLAVFRAPTDGAQYASVVAALSGTVVTLTSALFFAQANSTRKNMTTQAVQLREESQDDRRITTVRELVVAVTEEKSRNELHAEIARSLINNLARRTEPGSPEAAPARG

SEQ ID NO: 15127 - protein, 153 aa, Actinoplanes utahensis
MALVGRRPGRDDVETSHGVRASRPLRSWFSVRIGLVLGHYAGGMTRDGIRGGQQRVDVLLDRLTDAEERLHQLGDGHWANWLARDRARVAQGDAYGLEHLKQAFGGMGSINDAYPQDDGAIGATLADIHRLAAQLLADHQAADGPGVHRSPPR

SEQ ID NO: 15128 - protein, 531 aa, Actinoplanes utahensis
MNPVRSGTPAEPVRPELEMVTGAVSQDAADRLAALTVRGARGDSAMIHLTDGRHMRLIGGHALPPGFEPMQQVPMPSTLAGLVIRTGFPVVIEDVEADDRVPGDAPVRAVGIRAYAGFPVRDPGGVIVGVCAVMSFEPRRWAPEDLTAVDDGAQACTAFVAEQRAHEAEHHQRQYLDILLDSLDTGVAACDAEGRMVLVNRSLRHRLGDRPVDGSAEQWIRRLPVTTPDGRPSDPDQAPLLRALHGTDVRGVEYLLHSGGQPRVLRVNAHPISDRRGRRLGAVTVFHDITEARRAEHLQAMLSRSKDEYLNLVGHELRTPLTLIGSYLELMNDADPDAPAAELLPMVAAARRGSERLRRLVEALLDLSALDAGRNPLNFADLDLVTVVSSAACQIDDRAAAKHVSLVQTTPARMPLHGDQRRLTQLVMALLENAVTYTPEGGTIRVTVSGTDSTAVLEVTDSGLGIPEHERPRVFDRFFRGAVTTELAIPGAGLGLAIAKLIAERHHGTIAIHPNDHRPGTTVRVELPRPL

SEQ ID NO: 15129 - protein, 131 aa, Actinoplanes utahensis
MAVIVVAEDEPDLLTVTERLLRRAGHTVTAVTDGAAAWEAVQRDRPDIVVSDINMPQLSGLELCRRIRDNPDTRLLPVILYSGALVPGDPGPGEVRATAVLNKPFLARELIDCVDKVLDAGHIDGQVPTAF

SEQ ID NO: 15130 - protein, 163 aa, Actinoplanes utahensis
MISELRSVDGVGLVRIEDRFNTGAADLWEAVTDPVRLSRWMAEVEGDLRLGGEFRAHFFASGWAGTGRVEACEPPRRLLLRTTQPDQVGEHVIEVTLIPDGEQTVLVWEERGMPIEHLPAYGAGIQVHVEDLAAHLSGGERSDGPARWAELLPAYQESAINGG

SEQ ID NO: 15131 - protein, 108 aa, Actinoplanes utahensis
MEAVVRALADESRRTVLDTLARGPATVGQLAAALPIARPGVSRHLRVLREAGLVDVRQEAQRRIYSIRVEPLAELDEWLGRYRALWQHRMDALHTEIARGKRERRSYQ

SEQ ID NO: 15132 - protein, 134 aa, Actinoplanes utahensis
MVREVVEEILRVGREHDVDAFVALMAPDGYIEWPYRPDGVPERLTGRDEIRSHLRAAAGFIRFDEYRDVVFHETTDPEVIIVEYQAFGTVLPTGAPFHQVIIAVFRVRDGLVVSYRDYLNPLPLIAAREEIARR

SEQ ID NO: 15133 - protein, 312 aa, Actinoplanes utahensis
MAHRPAPPGALIGQTGRVLTDDALPGLLRRLGLPGFADIHVHFMPERVLRKVWHYFDAVPPTLGMDWPIRYRQDEPTRLEILRGLGVIAFPALVYPHKPGMAAWLNDWCREFTAGVPGCVPSATFFPEPGVERYVRAGLDAGARVVKSHLQVGGYDPRDPLLDPVWGMLAEAGTPVVCHCGSGPMPGAFTGPGPIGEVLARHPGLTLVVAHCGSPEYAGFLELAATHRNVHLDTTMVFTEFTSRYAPFPAALVPRLADLGDRIVLGSDFPNIPYAYAHQIEVLDRLGLGDDWLRAVLHDNGARLLGVAGPAR

SEQ ID NO: 15134 - protein, 569 aa, Actinoplanes utahensis
MLIRHRFERREGRADDRPVEAGEPQVLHRERDREVRRGAGGPPVRRRERPGGEQPGREIAVDAQRAGQRQALPQPGQGGQHRGVLHQLHRRPGAGFADVPDLTQILEYAAGPLDRTRREDRQRSGGDRVHAPGHRRVHEQRDPGRDRPGLARGDRRHLHHHRLRRHRGRREDLGDRRPVGQHRDHHVGPGGRRGRAVRHGGPRGRRTVPGPVPRRHPMPGGQQPPGDRTTHPSGAQHRDLCHVRDARPRRAMPPATVSHGCHARLAWLAVETQLLEVFRTVADLGSITAAARRLRFTQSAVSRQIATLEAEVGARLLDRLPRGVALTEQGRALLPHAEALLDRLHAARQSVELTTGRLRVGAFSTALAALVPRAVAAFRAARPGFAVSLVEGLSPALLDRLAAGDADLAVVSTAPGGPPDPARFDLHHLLDERMLIAVPSGHRLARRRRVRLAELADEPFIASSARPEQTLLGDSAAAGFRPRIDVAVSEWTAKLGCVAAGLGVTLVPSLAARAIPADITLLPVHPDDESVRRVYAATLAGRTRPPAVEAFLTHLTGLCSPAGTTRARW

SEQ ID NO: 15135 - protein, 136 aa, Actinoplanes utahensis
MRVSLDSPLPTPFADRFADVARVDLPGGALLTLAGQVAVDDTGTVIAPGDAGAQAVRIFEIIGGLLAAHGAGLADILHIRTYLTDFQDLPAYAVVRRRLFPQNPPASTTVQVSALFLAEARLEVEVTAAIARPAAG

SEQ ID NO: 15136 - protein, 438 aa, Actinoplanes utahensis
MTSWTQTFRERARTRLAEAESRNAPPPFTGPDVVVVEPRPSSADVLPSSIRTAGAWAWRFILFVVAAYLFLRIIALLHIVLIPVAVAILLAALFQPVCARLVRNGMKRSLAAGLVEVAALLLVFGGLGLIVRTFITQFDNLSTQVGGGIDEIQRWLANGPLHVTDAQFSDYIDKARQSITHSQGSITTGALNTAATVGEVVTGFFLVLFTLFFFLRDGGQIWSFLCRLLPRDARVPTARAGHYSWHTLVSYVRATVLVAFVDAVGIGIGLVVLRVPLAIPLAALVFLGAFIPVVGATISGAVPVLIALVANGPVTAISVLAVVIAVQQLEGHVLQPLIMGRAVALHPLAVILAIAAGVVVAGIVGGLIAVPLLAVLNTAIRYLANHPDGEPTADREPPGTESTDEGEAKAEEREEAAERRLDPADPPADDTSVVPDRG

SEQ ID NO: 15137 - protein, 211 aa, Actinoplanes utahensis
MWRVLRWVMVALWVVAAGAAWWAAPRESTAEQASADIADHRVVAYQFGSGWHDTAPDRWFSVPSVDVKTSDPQAIFAWRTPDHRTHWVRDLHPGLDPAGSGTLISLSTLVNGIGLLFTVVFLGVLWAGPPPLTGTRWYWWWLFALVPFGLGLIWWTFREYPWNREPELPERRRTGFRGFGTAFVVSLGVSVALLLLRRVFGDILFPDLLTP

SEQ ID NO: 15138 - protein, 277 aa, Actinoplanes utahensis
MVDRSLTLMAVHAHPDDEASSTGGVLARCAAEGITTVLVTCTDGRCGDGPGGVKPGAPGHDPGAVAAMRREELEASCAALKVTHLELLGYADSGMMGWPSNDAPGSFWGVPVAEAADRLADLIRRYQPDVVVTYDENGFYGHPDHIQAHRVTMAAVALTGVPAKVYWTTAPHSGMAALGEALRELGVDWAEAEVTEDAPPPAIGLPDAEISTWVDTRAFGAQKYDALSAHASQSENIEFLRMGKERFTDLMGVETFVRVRDTTGAPLPEDDLFAGLR

SEQ ID NO: 15139 - protein, 154 aa, Actinoplanes utahensis
MKANDRLQEALRLAVDPPGGVSVEALQDLVREDLSPQWDIATTADHIGVSPHTLRYYERAGLITVPRNGAGHRVYDAACVRRLVFLTRMRTSGMPISDLRHYVTLVDRGEDTVPDRLDLLLEHRDTLRAQLTQIQLALAATEYKIATYGGATQP

SEQ ID NO: 15140 - protein, 141 aa, Actinoplanes utahensis
MNDPQHDIDSVDNRERREHGLEVLARIDGAAGAAVIDSLADVSPALAHHIAAFAFGDIYDRPRLDARSRQLVTIGVLTALGGCEPQLKVHVGASLNVGLTPDEIVEAILHAAVYAGFPRALNATFAAKEVFDSRGVQTTAS

SEQ ID NO: 15141 - protein, 187 aa, Actinoplanes utahensis
MGCRPLPHDSGLGVCRERAAEIGADAGSLPALGWRVGLTHQEFFERYIHAGAISRDPDAVAALFTEDGVAEAPLAPDDHPLRRLVGRDAIRAGVGRYHRQLRLPGTMNPQRSAYVLHDTADPDVFIAEIDVALDRADGRQTTMSFVQIFRLRGGRIAVLRDYFTEPSPVAADVAVAVEPGEGSAAPA

SEQ ID NO: 15142 - protein, 192 aa, Actinoplanes utahensis
MVGSGLAAYGYLGVAVTVFVEGFGVPAPGETAIIAASGAAGHGHLNIVAVAVTAFVAAVCGDSVGYLIGRLGGRRLVLRYGRFVRLTPARFARFEKFMARHGAKVVAGARFVEGLRQLNGVVAGATGMPWPRFLVCNAIGAALWVGVWSTVGFVAGDHWTGILGALHRYQPYVIAAVVAAVAGALLWHRRAH

SEQ ID NO: 15143 - protein, 399 aa, Actinoplanes utahensis
MDALTGLAFRDRYGRLLALLSAASSDLAAAEDALADALERAVRTWPEQGTPANPDAWLLTVARNRLRDRWKSAEHRRTVALEPDWSGPVHVDDIDVEAIPDRRLELMLVCAHPAIDRTVHTPLMLNTVLGFTAAQIGRAFSVPAATMATRLVRAKKKITTTGIPFRLPARDDLPRRMTAVLEAVYAVYVLDWSTTGPEPRPVPSEALHLAEVLAGLAPGDPEAHGLAALVQLSAARAAARTGPDGSFVPLTEQDPALWDRRLIARAHRHLRAAHARGRLGRFQLEAAIQAVHCARPAGGQTDWPTLLTLHRALDEVAPSLGGSVALAVVIAEADGPAAGLAHLDTLDAPRFQPARVARAELLRRLGRTAAAAVAYDQAIALTHDPAERRHLHHRRAGLG

SEQ ID NO: 15144 - protein, 105 aa, Actinoplanes utahensis
MRYALLMHYPEPADGEIGEEMLAEGRRLFGVYGAALHEAGVLVSADVLQPSFATTTVTRRDGELRVQDGPFAETREVLAGVFLVDVEDLDAAIGWAEKCPGAQWG

SEQ ID NO: 15145 - protein, 234 aa, Actinoplanes utahensis
MRELAWLGIVRHGQSIGNIAAERAERGNAEVIDLAERDADVPLSPTGEHQAQAVGRLLAAQPPDLVIASPYLRTRQTAGIALTGLDVPLLVDERLRDRELGVLDLLTNAGVRARFPEEERRRARLGKFYYRPPGGESWADVLLRLRSVLRELREDHAGARVLLVAHEATVWLVRYLVEGLAEPELMSLARGQAIANCSISAWRDGTAERFNDVGHLAEHGAPATEQEEVRAEPA

SEQ ID NO: 15146 - protein, 275 aa, Actinoplanes utahensis
MPSRPEIITPRLLRDWPLPDPQASASKQDRGTVLVVGGAKFTPGAVLLAGVAALRAGAGRLQLAVADEAAIPLSIAVPEAKVVGLPEQVDELAADADVILLGPGLDDIGETEALMRRVLGAAGKDTAVVLDAYALGALSREPDLLPQPAAVLTPNLTEAAHLLGREPGDDLVAASRELAQRYRAVVSLYGHIADPAGNVWREESGDAGLGTSGSGDVRAGIVAGLLGRGAEPAQAACWAAFAHAVSGQRLSPRHGRTGFLARELVDEVAITLATV

SEQ ID NO: 15147 - protein, 729 aa, Actinoplanes utahensis
MAGVALLAALAEVLLIMVGTHLGFPHLLVWVPAVAGPALATVAFHRASRRTDGVLRAFWRRVAVAMGVVALAGLSQTVDISTMPYSDLPPIGARTLLLYLAGATLASTALLRLPGGGSSWRRLTTAVLDVAVLAVTGGIAVSQYLGWFMNRFGVSAAAWSLNIAMLAIAVAGAVVVIKIMAARSSPVPRAALWWLAPIGLAGPLSTVTMALLKPWPHLNGSAAVLPFVGLCGVLAVRARPQAVRLDRPAGPGRGTAIPLVATGLTSVLVATVFLRTGHLSTVQVAGTTLLLLLVVARQAAALAENGALLSTVHHQAMHDELTGLHSRRSFTAAAAGAHTAVLLDLREFRAINDGLGPAAGDALLIAYARRLTALAGPDAVVARLGGDEFGLLLPGPTDIVARLLAAGAEPLDAAGHDVLVEVSIGVAEGGTDLYRQAGIALREAAAGAGDRVVRYDASLEQRLTRRATIAADLRRALAAGEFHLLYQPIVDLPDGRLSGVESLVRWQRDGHTVSPADFIPVAEDTGLIVELGAWIIDTAIAQTASWLREHGADTLRSVAVNVSARQLLDPNLPEVVALALARHGVPPHRLTVEITETAVFAGGRALATVSALSALGVSIALDDFGTGHSSLGLLRTCPVDAIKVDKSFVDGLGGAPQQEAIAVALHALADTMGLRTVAEGVETAAQARRLFELGYRQVQGFHFARPMPAEEITRRLTAVAPTTIAGVRG

SEQ ID NO: 15148 - protein, 728 aa, Actinoplanes utahensis
MLFLRHPPRTDEWFARRRDRTLADLLDQALAEPEFAGWLDARVPADRLRAEVCARAGTDVFPIVAAEQQAWEQATIHRLPSAVSERQLTGPRWINGIGKALIGLLAAVWAGVPIIAVIWAFLLDDPRDVLRVVGLIVLISGGTGAVFGMFFGLTDAAAARHDGESGRGHILPMVSLQSLMLIMLAVFFGGAGFIGAHTRGGWGFLGFGPVGLPVFCLVLSIGVGLLGLMLTVGVSQPSDADLDLPIRGPGGDAEQAFQNWRRELRERALLPFLRSRINEAVAARYSLTLDIQGEAPGLRSRRATEHHIVTPAVEQLFDHLEQLDGASIALAGPRGTGKTMLLHALRDGRHHHGDDPRDLVVVVSAPVEYAPRDFVLHLCLSICDVVGDYFAVHGPGPILRTARRRRAQLRHLRSDSRELSGRVGRWGAELTGKVGSSSQAQPFTYPELVAALHELLDEVVTALRGLPGPPKLVIGIDELDRIGSGEGAERFLNDIKGVFDTPGCYFLVSVSEDALRAFDLAGHGLRDVFDSTFDEMVRVEHLDFVRAVELLGRRVVGLPDPFVALAYCLSGGLPRQLIRVAREMARHRGHLTDVARALVSRHLERILQAGGAARGPMFAWADNPPAEMTETALLTYARLGPIGEPLTTHVEFLATVVAVFDGSLDAGRAKRSVAFEALARVRRYLGVDDEIAAGLLAQARAEWGLARRDGATPVPRQSWSEPQRSAGA

SEQ ID NO: 15149 - protein, 317 aa, Actinoplanes utahensis
MKHRPAAAFALVPLILGGLAACGGENRPESLPSTRPTVEFSAERTTRSTPTEEKTTEATDPTPTRTRPTADQPTREPTAEPTRAPTTQEATKEPTPAATSTSAAVAPVADQDDGGLGPWAWLLLIGLLTGLVGLLLVNRDRRVATWDAEARGLAGETRAVLGVRLPQLLTDLDPARRGSAWPPVRDDLTALEARWTALLERVPDGERQAYAGQVAGMLRDLVNAVDAENAALATGRDWRMLRPRVDAVIAALSAALDPGPAAPAAAAAAPAAPSPAPEPATRETSIYGEPLDEDPGDYPPPPPRAPRPGYRPPASTD

SEQ ID NO: 15150 - protein, 366 aa, Actinoplanes utahensis
MTPFTSKDHIQRMERAVAQATGAGLTGLLVTPGPDLTYFTGYRPTAITERMTLLVLDADHDPHLIVPVLERPDTAGAPVAVTDWADGADPYAVAGRLLDPAGRYAVSDSAWALHLLGLQQALPGTAYVSMTGALPMLRAVKDADEVDRLAGAAAAADAAYREILGVRFEGRTEREVGRDLAWLLREHGHSQVDFTVVGSGPNGADPHHEMGDRVIWRGDMVVLDFGGLKDEYGSDTTRTVHVGPPTAEEREVHDLVRLAQQTAFEAVRPGVPCQEIDRMARRVIDEAGYGEHFIHRTGHGIGLTTHEPPYLVEGEEQTLVPGMCFSIEPGVYLPGRFGVRIEDIVTVTETGGRRLNTTSHDLQIVA

SEQ ID NO: 15151 - protein, 480 aa, Actinoplanes utahensis
MAATDSPMRTDRAAGLGVLLAACVSALVVNANTSAVTILLPAISQDVGAPVTTLQWAVTGYMLVGAAVIVTSGALGDVFGRRRIFLGGLVLFVLSCAMIALSSSAAGVIAGRMIQGAAGSTILACGMSLLSVDSAGAGQMRAITRWGAASAIGAAIGPLIGGVLVGSTGWPGLFWIDAVIAAVCVPVTWLTVRESRDPDRPREIDLLGTVLVAVALVPLVLALSEGGSWGWFSFSTIACLLLAVAGAAGFVLAERHATAPLVDLSLLRNPVLVGATLAILLVAGVINALMYLLSLYFQNPDGFGMSALQAGLATLPAAAAMIAITPVITPLAVRIGPRYAVAIGFGLAAIGCGILVFTRSSWAYGAFVVPLIVLAAGLGLANGPASSASTSAVSPDQVGQASGISNMARYVGGSLAVAAAATVSNGVGDGRTATGAPPAEALTAGLAGGALLLALMSAAGVALALLLRRHRAAPVAAVHL

SEQ ID NO: 15152 - protein, 416 aa, Actinoplanes utahensis
MNRRADRSTYRRGMDELELRQFLLYLGSALTAAGEAVNRIEEHLLTVAAAYGSPQARVSVLPTYLVVSLEPGQPATLEPTRALRGGLRLDQTAMVYDVLRAAGRAELTPAEGIGQVLAAVRMPPRFGVVTRTAGHAVLICGICLIVAPTWADILLAALFGLVVGLMRLAGARWASAQMIMPVVAAFTVSAVTFVLAGTGWAAADLRAMVAPLVTFLPGAMLTMGVVELSAYEMVTGSSRLVAGSLQLLLLAFGIIGAAHVVGVPAPAAPSDVVANTVGWWAPWLGPLVVGVGNYLLLAGPRRSLGWLLLVLYCGWISQYLGNVLLGGYLSGFVGALVLTVVAYSVERLPTGPPALVSFLPGFWLLVPGVLTLIGVTEYLGQDTVRGAQDLVGAAASMVAIALGVLCGHPLFRAVAR

SEQ ID NO: 15153 - protein, 151 aa, Actinoplanes utahensis
MQSRNPVQPLLLMFPLGLLAVALILDLATLLGAPAIIGTLAYWNILAALVGGVFGAALDRPRVLILLADMGVLFFFAVLALIRVRSGDRATAPGVFLLELLGFTAALAASWFGGRLGANHSAGMRRATSRPADDSAQRHLAGTSSPRREAT

SEQ ID NO: 15154 - protein, 476 aa, Actinoplanes utahensis
MSAEADNQAAAPPRSTRAVSYLSWVALALMTTSSVASLRPSPTMAVYGLASIFLYLVPAIVFLLPTALVSAELASGWEGGVYNWVSQGLSKPMGFLAVWCQFAMTIFYYPSLLGFVASTLAYVINPELAGSGLWTAIVIMVCYWAGVWVSSRGTKGVAGLASGGLIIGTLVPGALLVILGIAFLGQGNESAAPMTADHLLPTWAGLSSLVLIVNNFLSYSGMEMNAVHVSSLRKPGREFPRAMFLAMALVLLIFILPALAISWIVPADELSLTAGVVQAFDAVFAAFDSQWLTPILGVMLVAASLGGMLTWLAGPSRGLLLISRKEGYLPPFLQKLNKQGVQQNILVTQGLVTTVIALAYAFIPDVSSVYWIFSVITTQVYLIMYLLMFVAAVRLRRNQPDHPRGYRAPMLTGLCGVGFAASLAALLIGFVPSSQFGGGSVGVYLAIVAGGALGLGLLVPYLFYRFRKPSWKEATP

SEQ ID NO: 15155 - protein, 134 aa, Actinoplanes utahensis
MSRWVYYLIGALLLLLAGFGVVNYQGKKVTEEATAKAQQLQTELAAAGMRVPATDQIVRVLSTDGGSICYEPGAALRRGVLYGMITNGAAGPGQRPVIVDSRLLQGQMTIIKVYCPEYIETFQQIVDDFTAAEG

SEQ ID NO: 15156 - protein, 445 aa, Actinoplanes utahensis
MDLRAHINELMPRARADLADLVAIRSVADPRQFPPAECERAADWVARHFAQVGFTDLTLHRTSDGSKAVYGQRRGTEPDAPTVLLYAHYDVQPPLDEKAWWTPPFQLTPVGGRWYGRGAADCKGNIVMHLTALRALGDDVPVNLKLIVEGSEEQGTGGLEDFVERHPDLLRADAILVCDTGNAAVGVPAATITLRGLVNVVVTVTALGGELHSGMFGGAAPDALAALIRMLATLRDPAGNTTITGLENEQTWLGAPYPAARFRADAGLIDEARLLGDGSVSDMLWARPAVTVLGVDCPPVVGSAAAIQPRARARLNLRVPPGTDPVKAQDALIAHLHAAAPWGVRVEVAKEALGQPFEARTGGPAYRALSTAMREAYGREMTTLGQGGSIPLCNVFAGAYPDAEIMLIGVEEPLARIHAPNESVAPGEIGDLALAEALFLQRYRK

SEQ ID NO: 15157 - protein, 106 aa, Actinoplanes utahensis
MPRPRESMQSIRGRVERTMTEILSIAAGHPWPAAMMMLSVGLSAVLRRWIDHLTACHREEQVTRRLFVALRDSSRRDRPAIVRACGPVGGGAGPGRVRRGRPGRAG

SEQ ID NO: 15158 - protein, 1174 aa, Actinoplanes utahensis
MAGGRPSQGKQQRYDELEELAAWFRQALGDAGFGSVHEFVATGMFEKNAVYGVFNATRLLTLENTQSLAVALRRDAGDVRAVWLRAKEARDRELLAAERAEERRLCSWADLPLPSLALRNLLESQSMSVDRLPYSMLGVIEPPLSTVYVRQHIRSQDKRDRQPAVSREGTPAERSPVSQAQTTLSVLEAIERHDHLLVTGEAGAGKSTMTSYLARTLSRVWLRETSAAGLPLGEPVVPLRIAARTLDVGGSWSVVLAQAVSRSLGRSLLQDPDPAIFTRRAQGARWLILVDGLDEIPDARQRREIITSIAQHARAGRDYRFVVTTRPLPDDDLSPLISADVARFAIQPFGHAELDQFARRWFGSQRLDDPEDRADRFLRETSDGRLKELVRNPLLATIAGVSAVRDPDRPLPTSRISLYERFCGYLLDDHGGRRETMAQLHRHYANDPDRLTCVLWIHKHRTAIIGALALSRTGDQTSLWSTAKEWVRRHAPHSVTEVEQWKSHLWEELLATGLLVATDGELAFLHQSFAEYLSAKSHASTLDADFAALDGWIRRGIGEAERTFALFVFGLWAARADHQAHRIVDVLLSRYDPRRTLLAGRILAEGVRVDDPAAERVVTRLDALIRNENDTDRALEAVQVLGGLFDYRWVSSRLAGLASLDSLPVRRRVEAIVALEQLAGPSAITEALNDVLPSCYGRPLRRMAPMAVRLGAPIVEQIRERVQQMVAEADADAEEWANAVEVLKKLGLQDDTERFACSVLSNPFARQDDLKKAAEALFDAKGMAALPQVIEFAQTRPAADYTGRAALADLLRREGAREASATIVEQILADDSGTSSSGIAAVTTDLHLRGSEAVPAVLRLEERWSRDGSWLASGDLLEAAAKVVPDDRIAGRARQRAVSGIPLGADLYVRAWLAVEGIAAVPEIMKVTDGGRRLIFLDRVWVAKALHDVGALPEAWELAENALRCKDRGLRTRYRDAGSLLLKVDHDRGIPALMEIVEGDANNFPLLGGLLDALQEHDSPTAERALRDLADKLTHNPYVSSVELRDALITLVRCGEKPAAVVAAQAAIHRQNLTIDDRKEIAAALASYAELELAQEVWSHLMRWQEYSLSSDVTLVDDMIAAGAADWAAQELRAQLDDPLMAARRRTRLRQMLALLTAAADVPGPAHPDDAPGR

SEQ ID NO: 15159 - protein, 173 aa, Actinoplanes utahensis
MFRRSGWLSLLAGVFALVLGIVAFAWPSATLHVVGFLFGLNLLILGVVRVVQFVLIPDAPVAGRVLGVIFGVLVGLLGILCLRDLAGSLKLLLVIVALGWMLDGLAEIFTSVGSGGGGARIAVGLCVVLAAVALLVWPGLGLATFVFFGATTLCFVGIAGILIGIAGLRSRSA

SEQ ID NO: 15160 - protein, 151 aa, Actinoplanes utahensis
MSETQQETAYADEQPYTPPGATREPTAWIGAVVFAGVMLMLLGGFQAIEGIVALVRDQYYLTTRSGLVLTFDYTAWGWTHLLLGVLAVLTGIGIFLGQMWARVIGIIVAVLSAFANMMFLPAYPVWCTIMIATDVLVIYALAAHGREVRYR

SEQ ID NO: 15161 - protein, 141 aa, Actinoplanes utahensis
MTLLVLLVFLVLLAAVRRERRTRRAFAEDGPAFRCRVRFRRRWSRRMWACWAGELLLIRRGPVFDRTLRLPVRVLPPGVHRLPAGTGRRCGPDPIVVRLVAADGTVFAVVAAGADRVELVGPYLAAAFSDLPRAPVRRREI

SEQ ID NO: 15162 - protein, 74 aa, Actinoplanes utahensis
MPDVTYQVRVSGVIPDELLAELRDLTVSVEPPETVLHGNLPDQSAVVGLISRIHGLGLRLIEVRRLPVDDGPAG

SEQ ID NO: 15163 - protein, 273 aa, Actinoplanes utahensis
MPTSGGRPLRHPAEMPFYVFMVVLNLIIIWLIVQAAVTLPYLPDRLAGTGWATTVRSAFIGLLLLVPVLVIIRETQRASVRGTAVELSPHQYGELYKTADDFAHRLGLPRRPTIYLANGNGTLNAFAAQATGHDYVVLSNELFANLQQNNREGLRFILGHELGHIRLHHVSLWYQLSVAYSERIPVLGPTLSRLREYSCDRHGAHLCPAGASGLVLLASGRHTEHTTDVQQLLRQGRALRGFWVELAQLPQSHPYTVRRIERLFRLGLLHGTD

SEQ ID NO: 15164 - protein, 416 aa, Actinoplanes utahensis
MALLAFVAAAAAVVLVLAVAGIGGSLALLLTGVAGGAVMLLAAWWFLSHRGVARWAAGCLAVLAPVVVAVLFARARLVGVVVVFGLLWWAAIAAARRALAVPVPEPVTERTAAPRHPYLIMNPRSGGGKVGRFRLAERARALGAEVFLLDGSTVDVAEVARRAVRDGADLLGVAGGDGTQALVAGVAAEHGVPFLVISAGTRNHFALDLGLDLTDPAAGLDALTDGEEVRVDLGRIGDRTFVNNASFGAYATVVHSPRYRDAKVGTALDLLPDALTGRSPLRLTVDGATLDGPHAVLISNNAYRLDSGQRPRLDRAELGVLAAGRRRVVVRTTRDAVVDADLPEIPVGVDGEALTFAPPVRCVTVPGALRVRVPRQRPGVPVPPPQLDWRRLRHLAFGRVTQALDGAAVSGEPLAA

SEQ ID NO: 15165 - protein, 180 aa, Actinoplanes utahensis
MAIGPVQLIVLGFRHPDFHGEVIAELERLRQSDTVRVIDALAVYKDAGGEVEVEHLSNLTREEAIELGSKIGALIGLGIEGEAGMEAGAALGAAAADAEGRVAVFDDGRAWDVLAEIPDDSAAALILIEHHWAVPLRDAIARAGGFRIADGFISPFDLIGIGLLNAEEAKELHDLETAGA

SEQ ID NO: 15166 - protein, 132 aa, Actinoplanes utahensis
MKRILVVIPLLAGLTGCVSPAEAAKPPVCNSWAAVQQTVGHIREVNVSANGLSALRPYLIQLKTELTQFFADAKAQFGADGEALKASVEQLGADLRTARADPTVANLSVVRTSVSGVRDDANRLHDTMLSTC

SEQ ID NO: 15167 - protein, 322 aa, Actinoplanes utahensis
MVGDRDRAGRADHLGGRGARRRDGRRVRVVIGRLDAWQRRHRVAGFGHAVLRKYLDDGGPREAALITYYGFLSLFPVLLLAVDLISRVLVNRPGLRSRTIGAFVPEPLRADVEQAVAHLPTSAVALVAGLCGLAYTAAGVLLSVYQTLNHLAAVPYRERSGVLSRCLRVLAGLVVLLSAVVATASLPPAGAFVVAFGALWLIARLLLDRPAPLRALWPGALIGAAAVTLTLQLGAAVLPRLIRGAGPVYGGFATVAGIFTLLYVVSNALVGAAEVAAVRWGRLWPRAMDRGHPSPADLRAVALLKREQERLSAEGTRRRPDR

SEQ ID NO: 15168 - protein, 462 aa, Actinoplanes utahensis
MVDTTARALRRALIPFALAQFICSFAGSNMNVMINDISADLGTTVAGVQLAITIFLLVMAALMIPGGKLTDRIGRKRCLTVGLLVYAVGALLSAAAPGLGVLILGNSLLEGVGTAMLIPPVYILTTLLFTDVTSRAKAFGAISAMGGIGAATGPLIGGFLTTAFSWRVAFLFQTAVVLLIAVLSRRWVHDPLPADPTRPTDLGGAVLSALGLVLVVSGILAADDNVAVMIALLVAGAGVLLWFFASMRAKERTGRPALLSMTLFRNRTSNLGMVTQSAQWLMLMGTSFVVSAYLQVVRGYNAIETGVVFTATTAGLLLSSLAAERFAKRRAQRTLIVAGFLITMAGVVLLLTLVYASKSVAMFVPGLFVIGFGLGGMLTPSVNVVQSSFGEDLQGEISGLSRSVSNLGSALGGAVAGTILVAELGSRPGTGYAAAMIAVAVAGLIGLAAAWFLPRTAAPAPA

SEQ ID NO: 15169 - protein, 185 aa, Actinoplanes utahensis
MIGRRRRSDLRRISDRLESLLVFLLVLTFLGGAPLLARWAGGASYRSVQQAAEWERTHLSQVDAVLTENPSPGGDSATAAAANARWKAPDGTAHTGLVQPDSGLRAGDRIRIWIDDTGAQHLPPADRDPVGQAVLVGIATTLCLAAGLTGIHRIARGVLDRRRDRAWTRDWLRVGPVWSRDSGRY

SEQ ID NO: 15170 - protein, 163 aa, Actinoplanes utahensis
MTRPRIRLTHKTEEATAAGIYGIIVGAAVLVTAHGVAAWREVLAVLATLTVYWVAERYARIVAERIHEGHRPTWHVVREHLTSGWELVTASLLPLLVLITIRASGAALLNAEIISLSCSTLLLCLAGWSIGSGGRLTYLERIVSTMVAGAFGVSMVVLKALLH

SEQ ID NO: 15171 - protein, 175 aa, Actinoplanes utahensis
MVASTYYLAMPLFGVLSLFGWLVIGGCWVGVVATSALAMLASCRDRAYGWAVACLVVAVLSGVGVVSTDWRPVYTDSQFRLHRGELGELAAEYQAGRLVSDSELPWRLRYLSIDGQAHVRDGALYLPVWADWRAESGGGFAYFPSSPGPDTMVGTAAGDTGRPVRALGDGWWWVD

SEQ ID NO: 15172 - protein, 159 aa, Actinoplanes utahensis
MCRMQQSRHDLERQANDLAGMAARAHAAGRPDEALAHAGRAVAVVEAIVAAHPADAQAHWVLAGQLYNRAGIHESLGDFAAAAVDAARSFEIYQRLAAVAPLCLPQRADAEARLARTSAFAGAQQGVDAGPTREHAAAAGDRELRAGPVRAGRSAAGAR

SEQ ID NO: 15173 - protein, 251 aa, Actinoplanes utahensis
MLTIAHVSDLHLGAHHDAAVQSLIADVAAVRPDLTVVTGDWTMRARPVEFDLAKELLKRLPEPVLSVLGNHDLPLAGPQRLLRPYDRYRTWICDDLDPVIHLAGLTAAGVASMPRWRWKDGRVTRQQTTSLTAAFAAAPPDGLRLIALHHPPTGRRLVGRSRLLTAAREAGVHLVLAGHTHIPEVRRLAGGPVLITAGTSTSRRTRGTPRSWSRITVAGGTVTVVERYPSGAGWHTGRLTTVPGSPVASGG

SEQ ID NO: 15174 - protein, 322 aa, Actinoplanes utahensis
MRIVIAIGGNALLHRGDRPDAGVQRANAVRAVEALAPLAAEHEIVITHGNGPQVGMLALQSAADPGLRAPYPFDVLGAQTQGMIGYWLLQALQNALPGRQVAAILDQTLVSAADPAFAAPTKFVGPVYDEDTAHRLAAERGWTVAADGPKWRRVVPSPQPQRIVETRIIRQLLFDGTVVVCAGGGGIPVIRDDDGRLRGVEAVVDKDLATSVLAESLDADALLLLTDVPAVQRGFGGPAPEPIGRATPGDLRREDFPAGSMGPKVEAVCRFVELTGDLAAIGALDDAAAILAGKAGTVVTPAGDYGGPHDLRPPRRPGLPSR

SEQ ID NO: 15175 - protein, 333 aa, Actinoplanes utahensis
MSVNLRNRSFLKELDFTPDEWRFLLRLAAQLKAAKYSGTEVPRLTGRNIAVIFEKTSTRTRCAFEVAAHDQGAHVTFLDPVSTQLGHKESVKDTARVLGRFYDALEYRGFGQDSVETLARHAGVPVWNGLTDEWHPTQTLCDLLTMREHTVKHDNEVAFAFLGDAHNNMGNSLLIAGAMMGMDVRMVAPESRWNPEEVIKAARAIAETTGARITHTADAAEGVHGADFLYTDVWLSMGEPKDAWDERIRLLRPYQVNSELLRAARNPAVKVMHCLPAFHDRRTRVGEEIFEHTGLEALEITDEVFESPASIVFDQAENRMHTIKAIMVATLGA

SEQ ID NO: 15176 - protein, 406 aa, Actinoplanes utahensis
MPFHVDSETGRLRQVILHRPGVELSRLTPDNVKDLLFDDILWARRAREEHDAFAEVLRERGIKVHYFAELLADVLDIPHARSWILDRIITENTVGPTLTGPLRRLADQAESGRLADYLIGGVLKQELAGFTVNSLRWELMSADDFVLTPLPNHLFQRDNSAWIYGGVSVNPMAMAARHRESVHSSAIYRFHPMFTLADFDFWYGGDDRVHQPATLEGGDIHVLGNGAVMIGLGERSTAMGVENLAHALFTAGAATRVIAIELPHSHAMMHLDTVMTMIDRDTFVMYPYLQEALRSWTVRPGDDEDGLDVTRNDDLFATIAETLGIDKIQVLETTEDIRAAQREQWDDGNNFLAVEPGVIVGYERNVTTNTFLRRHGVEVITIAGGELGRGRGGPRCMTCPIERDAV

SEQ ID NO: 15177 - protein, 525 aa, Actinoplanes utahensis
MLPLLQRGAQPVAVLQHRDDRAATAASRGEGAARAFRGDPAGGLRAARRADRGVAGGARGVVRRDPEGRRRTGPLRTGRAVNRTLGLPQATALILGTIIGVGIFNLPYSLAGIGPISILAMVLTTVGALALAVMFAALSRRLPADGGPYAYARAAFGNTVGFVNAWSYWITAWAGNAAIVTGWVFYVEHFVNKDGKTLWSIVIALVGLWIPALINLTGVKNMGAVQLWTTVIKFIPLVNMSTAGLFFISTANYHPANLTGGGDGKAIGSAMAICLFSYLGVECAAVAAAKVRDPAKNVPKATVLGTLGAAVVYLLSMIAVFGIVPAGTLADDKASYSAAANLMAGGGTWAGDLTALAVIVSGFGALNGWTMICAEMPLAAARDGVFPALFGRLSKRGVPAAGILSSTILGSLAMTVSYMGASGATVFNTLVLMTGITAAIPYAFSALAQLRWRVRGRLTRDAVIAVLALIFAILFVWYSRNTGQDHWYVVWGPFLMAGAAFLLGVPVYLAVRRHMTAPPPVPAHE

SEQ ID NO: 15178 - protein, 276 aa, Actinoplanes utahensis
MPEFSGLPERLPRRWRARAALILGSRVGTVAMRGFAELIRVQIFDRAMTLAAQSFTSIFPLLIMLLALLGPAYRARLTDLLHLPSGSERLVQQALSGSRSNAFGVVGCLIVILSATGLSRALVRSYRAVWQVAQTPAGPAATGRQVGTVLALVAVLLVARLLGRVAARLPAPHVSGVLFTLVTDIGLAVLLPWLLLGAAAPRRPLLAGAVVFGLLMIVVRAAGVVYLPRALQSSTDRYGTIGLAFTYLGWLYVLAFCLLLAAVAGGMVRAAPVDGR

SEQ ID NO: 15179 - protein, 869 aa, Actinoplanes utahensis
MRAGPGSAPPAQVARPRPPQGLIWRPRLAETLDRGTRQAVTLICAGPGWGKTALASAWAGARAVSGPIAWLTCAADHNDPYTFWSDLLLALRTSGAVRPGQSVPQRGPVVPAEGPDFLRRLGSGLAALPGPVVVVLDDLQEITDQRILVGLSGLLRHPPDRLRLVLISRTDPDLSLHRLRTAGELTEIRARDLAFGVEEAAELLAARGRRLSAVDLAALVRATEGWGAGLRLAMDAPAGVGPDEASADYLVREVLAAQPTPVRDFLLGTSVPDRINGSLAEAVTGRPGEQLLARLERANLFIERVGGHGWYRYHRQFRAALRGQLARECEDVAARVHLLAAQWHAGRDNPLAALHHAAAAGDWQLVTRLLVDHGLALFVSPDRVELIDLMRRIPLARLPETAESTLCLVMLRYGLGDLSGLARGIDRVRELLRERGHGGRELIATVLDLFEAALVIRWRGDMPRLVTTTTGVLTDLARLHRDEAPAVLRYRAMALLNKGIGLLWTNRLDHADRYLWAAATGARAAGIPLVEVNALGHLALLALIQGSLREAGEHADAALGVARRIDAEDRFSVTPAYVVRASLDLWQGAEPEAEEALRRALHSSGEQPETAMTVLMAVFRAYLLIDRGEPRTARTVLATLAAEAGPALRAPMLDRIVELAHSEVDLALGDPRPVLTRYAHRDGLYPPEQLLLAHARQLTGRTAEAEELLALLRDGPDRVAAVSAWLLTALAADAQGRGQRAGEALGQALAAAEPIGIRRPFRRFDNARVLALAERQQWLTEPRGRVGEGVLAEITGEIPIGTPPTAGPLSEREIDVLQYLPTVLTAGEIAENLGISVNTVKAHMRSIYRKLGAGRRREAVVIARQLGLL

SEQ ID NO: 15180 - protein, 148 aa, Actinoplanes utahensis
MSNSYASERPAGADSPAPPATDWTGVVAFAGIMLIALGVFQVTEGAVALHHQEFHLVSPDGLLIETDYRVWGWGHLLLGLIALAGGAGVLLGRLWGRIIGILIAFLGALVHFMFLAAAPLWCTILICTEVLVIFALAVHGRDVRRTQG

SEQ ID NO: 15181 - protein, 869 aa, Actinoplanes utahensis
MSIDLIADSPGISEHDADGSLLASKFTVPAAPPFMVARPGLLDRVSDGVRGPVTLVTGLAGSGKTQLLASWARSRAVPWPIGWVTCENGDEPATTFWSYVLEGLRRAGVPAPEPAVPGAAASRAVLARLAAVIDQQPTPVVLILDGAAQLPGRDWAAGLEFLLAHAPGLRVVLAGRWDPPLPLYRYRLAGQLREVRGADLAFTAEETARLMELHGVPLAGPDLTALVEHTEGWAAGIRLCACAMQGSADVTRMVATISGDESTIAEYFIGEVLRTQPPAIRRFLLETSVLDTFSADLAATVTARPDAARLLAALTRENAFIQPVGDGTDLYRYHRLFAELLRAQLTWLEPDQVTVLHQRAAGWLSRNGRLADAVGHAVEAGDWGAAAALVIEDFAIGRLIVEGTAGRLGGLLAALPENLDLPEVVMVRAALAWGDARLDAARELFALAGNLLATRGGDCGEGMTLSSFVMQLLLLAGGPDPERVAELAPVATAFLAVAPIRKLARHPELRAVLLAAEGTASSAAGDVTGAVEVLTDAVAAVPPGDEALKVDCLRLLAVLEAHRGRLGRAENAARQAVDLAGQCGLPAGRRPIAAQVALAWVALERFDIEAADRHLRGAGAGTDPVAAAAYAVVRSRRLQVRGELRSALNVLTPVPGAPAWLRREIELGRARLLLGAGRLDDAAAVLADCPQPSPDVAVVQAALALARGESDRAHEVARTVADAAGVTAPVALDAWLLLAMLAASSDDETGAREALRRALRVAGPENVRRPIHQVWGTLRRVLRDDEKLAAVGGPQPGSAVAEPVLVEALSKRELDVLRGMAEMLPTEEIAASMYVSVNTVKTHVRSILRKLSASRRNEAVRRARALNLL

SEQ ID NO: 15182 - protein, 442 aa, Actinoplanes utahensis
MNPVIYEIDTWPWLAGLGRTLGDVPDEVWDQVCVPGLDAVWLMGVWERSPAGLEVARTNRELQESFREALPDLAGSDVVGSPYCVRRYRVDDRLGGPAGLAAARAQLRRRGLRLFLDYVPNHVAPDHPAVTAHPDWFVHMDGAIANGRDPYFPPWPDVMQLNAFAPGMRAATVAALSSIAEQCDGIRCDMAMLLINEIFARTWGEHVGPPPEREFWPEVIAALRDRHPDVTLVAEAYWDTEWTLQQQGFDHCYDKRLYDRLVHEDAASIRKHLSAGLDYQNRLIRFLENHDEPRAAATFPDGRGRAAAVVVATLPGATLWHDGQFEGRRTHLPVFLARYPNEEFNLELRDFYTRVVGAAAPLRHGRWRLLETGAPDLLAWAWEAAIVVVNFADHWSQGWVTLPEPGRAWRLVDRLDGRVFDREGDALFVDLPPWGTHVLAVK

SEQ ID NO: 15183 - protein, 868 aa, Actinoplanes utahensis
MDATEHAEQRRLTDADSGAVDWRRWGPYLSERQWGTVREDYSPGGDAWDYLSHDQARSRAYRWGEDGIAGFSDDHQRLCLAVALWNGRDPILKERFFGLTNAEGNHGEDVKEYYFYTDATPTHSYLKMVYKYPQHEFPYTGLVEGNRARGRGEFEYELLDTGIFAEDRYFDVVVEYAKAGPEEILTRVTVHNRGPEEAVLHVLPTVWFRATADQGLLVRDGGAVRAEQGSLGQRWWTCLGDPTVLFTDNADGRKDAIGRWLIQGEKEAVNPGEAGSKAAAVVTVTVPPGGSHVVRAMLSDRPSTGSDQDSRSFDEVVEARRAEADEFYRNLFAPALGEPERQVARQALAGMIWSKQYFGYDVEQWLIEHGRDPLDAPGIRNGEWFHLDAHDIISMPDTWEYPWFAAWDLAFQAVAFSVVDLNFAKSQLDLLLSRRYLHPNGQIPAYEWNFSDVNPPVHAWACYLVNELQKARTGQGDHDWLERAFHKLAKNFTWWVNRKDVDGRNVFQGGFLGLDNIGVFDRSAPLPTGGHLDQADGTAWMALYCQNMLQIALELAGRDPVYLEQAQTYFEHFAYIAAGSRSMWDEEDGFYYDLLRMPDGSSRTLRVRSMVGLLPLAATTVFDRTLIDRHPEVLADAQEFLARHETLRLSDGPGRLLALFDADRLRRVLARMLDENEFLSPYGLRALSKFHEAHPFEFRVGDQVFSVSYQPAESDSGMFGGNSNWRGPIWFPVNALVIRALLNLYVGYGDEFTVECPTGSGQQMTLFEVARELSARLTRIFLPGEDGARPCYGGQTIFATEHWRDLILFSEYFHGDNGAGLGAAHQTGWTGLVAVFPNLFAGLTGQDLLAGGMAGVFRKFSGEGAAPR

SEQ ID NO: 15184 - protein, 164 aa, Actinoplanes utahensis
MATLVAIGYPDETTATAASLEANRLAKDLIIQPDAIATIIRDREGKFHVSTNHHAVGGGATWGMFWGLLFGMLFFIPVLGMAVGAGLGALTGKLAKGAINKEFQERIRDELQPGTSALFLVVESVTPDKAVEALSHYGGTVLKSSLPKETEEELQEALHGGAQR

SEQ ID NO: 15185 - protein, 68 aa, Actinoplanes utahensis
MRERYEIRVRGFLGPLLRRTLGDLRIRTMPRQSTIRGRLSEHDLERLLTRLDRSGVQVVCLTSVGESR

SEQ ID NO: 15186 - protein, 371 aa, Actinoplanes utahensis
MRSAPDTRPAGPRLRPPAPVAVLPRGVLVLLGFACLVVVVAGLRWVAGLIGPVFLGLMLVVTVAPLTGRLRRRGLPVWLAAVLTVLVTYLILAGLGTALAVSVARLIDLMPQYQAQFAALRDDLVSGLGALGVSAEQMHSAVAGATPDTVVRVIGSLFGGVAGLLSNTLFLVAVLLFMCLDAVDFPARLSTVVADRPQVVVALRSFARGTRRYLVVCTVFGLIVAVCDTLLLWWLGVPLPLLWGLLSFITNYIPNIGFVVGVIPPALLGLLQGGPHLMLTVIALYCLINFVIQSVIQPKVVGDAVGLSATVSFLALIFWAWVLGGLGALLAIPLTLLAKGLLVDIDPSTRWMNVLLTSSSTKDEAPGPDAP

SEQ ID NO: 15187 - protein, 165 aa, Actinoplanes utahensis
MTTFTVWKYDDPQGAEHAFRAIRYAADDNLVEVVDHATVSWPAGAAEPDTHHAHDSNRQGVGWGAFWGFVFGSLFFMPVVGSAVGAGIGGLTKASEGTGISQEQMDRLRAEIIPGTSALFLVTEYGDLDRLAERLHGMGSRLISTNLTDAERDELLEAFGDHRTA

SEQ ID NO: 15188 - protein, 31 aa, Actinoplanes utahensis
MRIRPGKRGRALVPPESGPAAAPTRDYLEPR

SEQ ID NO: 15189 - protein, 123 aa, Actinoplanes utahensis
MATSDSPTRSASGGVRTAGWRIATVTAVIAVVVPATAGAAYASGGTSGRTNNCYSTWGNTGSSAHCLPATATGYYQNHLVCNGEGDKVSNWVLISNGATVDNWGQLNCRFKASSADVRYRGSR

SEQ ID NO: 15190 - protein, 486 aa, Actinoplanes utahensis
MRHRGRRLRRRSICTRRRPIGTLGHMSRTERPLDPSSGPAAAFALQLRELRVAAGSPKYLQMARRTGRSGTALAEAAGGDHIPQWETVEAYVRACGGDPAEWADRWEQARDAASRKAHGAPPASVAPDPAVGPEDAARDGWSHRRDGVLTGRPMLLAVAAVALVLLGMITPRPGALFGRHPDTAGVGQIHVARPAAVTLVAFSRFGRFASGNFAVTGAGGAVEIWDTGPVARRHTLVTGDEQITEVQFDPLNRDILATAGTNGLLRLWNTTTGKSVLSIAGQAAGHSMTFAFDPRRRGIVATIGAGGTIRILQTETGRIVRELHTGLTDVTALTFDCQNEGHLAAGGDGALEVWNSGDGTRVSVGEKIPGRVTSIRFDPLTRNTLAITTAGAPPGIWDASNGRVVRFLRSDARPTVTAFNPLIRNSIATDDGHGDVQIFDASTGLPVHTLHGRYGPITSLEYAPDGATLAVGARDGVVGLNAVDDW

SEQ ID NO: 15191 - protein, 180 aa, Actinoplanes utahensis
MITGVNAEAPGWLVELLRRHTVFDEMLMSAWLDKDPPERAVIFGKDAHLGGPAGWLSMVLADGDYSLRLSGPDRPRLHEELNEDEFDAADDEDTRPLFVSVAGTVMSTYFPVRCRSVTLFLSAESELENGVARAVLFDLSTGPLFIDPFHLDGIRLAGAAEADALRTGDPGITVLEIPVG

SEQ ID NO: 15192 - protein, 509 aa, Actinoplanes utahensis
MSSSGPNAMRPPCGTGPGRASSAQGETPGFGTVHPCRMRCRTAPVRDRRRVSSSPVTAEAEELARLRAEVASLRARLAERPPPQRQPGWQRRTLRRTTAAVLAAIAAFALVTSVVGLWAATTTLNTERWVATVAPLPQDPQVSAAVAEYASSQLFEVLDVEHRLRTVLPQQAAFVAGPITGQIRDQVRKIIGNVLRSGRFQPIWIDLNRRVHQRMLAVLDGRSDVLAARHDRIDIDLLPLINQGLREVGDELPTLFGKQITLPDLSSGAIPDNLRQRVEDQLGVSLPANFAQFTVYDAGRLWAAQQAVATAERDLALFVGATVVLLIAAYAVSPGRRRTTLQLGLWLVVAAVAVTAILRAVRREILAQVPAGTYRDGAAAAITSVFSLLRERGTQLIVIGTVLAVLAYLAGPGRLPRWLRTQVVRGARGIGVGSVRLVGHAPSWIAAHRDPVRIAGMVVAAILTLILSSWTALLVIVVLLAAYEVAVTLIARAVAPKGQWADRAPSQAR

SEQ ID NO: 15193 - protein, 138 aa, Actinoplanes utahensis
MALGPLELMIMSFPADRLNDGVLTTLDRLTRAGEMRIVDVLVVRADAAGVACTVELCELPGLSGDLAWARLATGLITATDVEEVARLADHETDVLAVLLEHRWVNDLAGRVAASRGTIVALNHIPGAPGHGRVLTSTR

SEQ ID NO: 15194 - protein, 149 aa, Actinoplanes utahensis
MSGLDEMGPVDYLCIEFPKGGLRGRALPMLLDLVDRRVIRVLDLLFVRKSPDGTVVALDGRELQLNGLGAFHGAASGMLGGDDLREAGQILQPGAAAALLVYENLWAAPLARELRESGAQLVAGGRIPIQELLAALDATEAAAAPAGGR

SEQ ID NO: 15195 - protein, 91 aa, Actinoplanes utahensis
MPGLLRGIARTAVIAGTATAVSNRVSRRQQGRWARHDAEDQYLAEQEQEPVDQEDPMTAKLDQLRRLADLKAEGLLTDAEVEVQKSRILHS

SEQ ID NO: 15196 - protein, 346 aa, Actinoplanes utahensis
MLTIGVEEEFLLLTADGAVSPTAAAAVRHARLPEQIKPEYMAYQLETSTRVCETLDELRRDLTRLRLIAADAAERDGALLVATGSAPLDGGPRQALTDDARYRDLARRFPDATAAGGTCGCHVHVGVPDRELATAVLTRLRPWLGALLSLAVNSPYSGAADTGWASSRYPAQLRWPTCRPPGVWPSADRYDAAVRDHVDAGMATDAASVYFWARLSPRYPTIEVRIGDTGLDVADSVLLAGVVRALVAALLDDVRRGEKIVPVASARVEADLELAARGRLGHGRRLLEKITPYLAGDVGEVYAGFERLRREGTGADRQRRLWARHSGGAGFVRWLAHATTPLAVAY

SEQ ID NO: 15197 - protein, 240 aa, Actinoplanes utahensis
MDPARRAGCRRTRTRQARRAAGRRRRRRTPGPLRGGRPGRRRPAGTGADPAGERAGPDPRADPRTAGEHRRRGGRPGAGRRGRRGHRRRPAHPADVAARRDRMTGYAGLVSRTLAYLIDTVAVAALTGAGVIALGVVASVVGSEARDLARFVLSSYLVFLPTLLALYCALFWGLAGRTPGMALLGVRVVRADGAPVRWPAALVRALLLAYFPIGALWLIVDRRHQGLPDKIAMTAVVREG

SEQ ID NO: 15198 - protein, 876 aa, Actinoplanes utahensis
MTATYHVLTVPEALEAENVDQQRGLSGAEADARRQKFGPNRFAEAKREPWWRSFARQYADPMQLVLLFAGLGSLYPLKQWGTGVLLLALTLLNAALGLHQEGKAAAAIDALQKMMIVKARVRRDGTLIEVPAEDLVPGDVVQLEAGDVVPADGRLLRAATLEIDESALTGESLPVAKNVEPLAEADVALGDRSDMAYMNTNVTRGAGELLVTATGMGTEVGRISKMLATDKGADTPLTRQLAKLTNQILIISGIALLASVLINLARGNEFTVVFTAAVAFAVSAIPTGLPAVVTTILSQGTQLLAKANAIVKRLRSTETLGSTSAINSDKTGTLTLNQMTAIEMVIPGRRYVVSGSGYSTQGSIKRVAGEPDTPLEEFLLPMILASDAVVTDGSMIGDPTEGALVVLAEKGGLDAQATRERYPRIAELPFDAAYKLMATFHEMSGKIRCYVKGAPDQLLARSNVTPDQRERYTAENDRLARQGLRVMATAYRDFDRLGDDLLESLQDLTPLALVGIVDPPRPQARDAIEQAHAAGIEVRMITGDHAVTAAAIAGRLGIRGRAITGAEFAAMSDEEADREIGGIGVIARVTPEHKVRLVEVLRRRGHIVAMTGDGVNDAPALKKADIGIAMGITGTEVSKEAAAMILTDDDFATIVKAVALGRALYANLKKYIFFQMGTLVGMIITFLVASIGNIAAGVPFVPLQTLWLNFTTQIFQSVGLGYGKAEADIMSHPPRRSDEPLLSRAALGWLGILGLIMGAVTLVVIGWADHGHDVDYARTMGLTAFSIANLAFSLTVRSDIRSVFSLETFGDKRFVVTTGLSAAAIVLATEFGLFQKILHTSSLGVRHWLICLLAGVVVVIPTEIRKAVLRRRNGSA

SEQ ID NO: 15199 - protein, 152 aa, Actinoplanes utahensis
MSSEPVKPSVNAGKLWAGGGATAAVAALIAVAGILLGRGIFDIGVLAPKGDGAWGDASTGWYALGAAVAALAATGLVHVLILTTPRPMRFFGWVVGLATVSAMLAPYVTDAERAAKVYTSGLTMILGIAIGSLIAGVARSATTLVRPRPSYR

SEQ ID NO: 15200 - protein, 483 aa, Actinoplanes utahensis
MPSRRLRRRGPAGSRRRRPGPRPGCPRCRRHRPRRRRAHPGTRRRRPGPRCPCPQGRNSRCRSHSMPCGSSYPEWIFLIHPGRLSARHRGNRGRMLLDDSVGLAVQGYGWLPTVWRRAGGGPVVQTRLLGQKVTALRGPEAVRFFYDESHIRRHGALPEPVQGTLFGKGAVHTLDGDEHHARKAIFLNVLKDPRHIADLVDRAGRAWDETAAGWTPGRPVVLFDEASRVLTRAVCDWAGVPVSDAEVPRVAADLTAMVDGFATLGPRHWRARTARGRRERWLEPLLGHSWIRGLDAVDMLNILRPTVAVSWFVAFAGHALHRWPRQAEPLRDGNTAYAIAFAHEVRRFYPFAPFVGGRAVRDLSWGGHDIPAGSMVLLDIYGQNHDADLFPEPYRFNPARFLGISPQADELIPQGGGDAATNHRCPGEDVVVMLLADLATRLARCDYSVPEQDLTIPLTRIPARPCSGVVLVPAAAEVFTPAG

SEQ ID NO: 15201 - protein, 388 aa, Actinoplanes utahensis
MTTSALARAVGIGEAEFADTYWGKQPLLSRGRAGFTDLLSVPAVDELLSRRGLRTPFLRVAQHGKVLPAGRYTGGGGAGAEVGDQVHDERVMRLFAGGATLVLQGLHRLWPPLIEFTGRLGAELNRPLQVNAYLTPPGSQGFATHYDTHDVFVLQCEGRKRWIIHPPVLSDPIENQPWGGHADEVAATAEGTPAIDTVLEPGDALYLPRGWLHSARTEQVRSLHLTVGIRSLTRYALVEELLAMAVQEPRLRATVAYRRNPESELTATIEALREWLPTVDPAAVAARMRERTGPATRPAPLSPLAQLDFAERLTDTDEVTARPGLSVDVDGGTVRAAGYTVTFPGYCEPALRLVLDGKPHTAGDLPLDRDDSLVLIRRLLREGLLTPA

SEQ ID NO: 15202 - protein, 119 aa, Actinoplanes utahensis
MDRPGVSNLGEWDDLAALDPAGAGDQPATGPTPGLDGAIAAALRSLDLGAAVQAAQKAIQQRIDRIVAKVVTQVVDQDVDALARLRTSAEESVAAALTTAADTPSLYYPSLRRSGRFGS

SEQ ID NO: 15203 - protein, 192 aa, Actinoplanes utahensis
MLYCYALRIRQPVVSPSGAVATFPLVYAGVGAEVEPFQALQASLSQYFDGDFDAALAEDESAALADADRIIAEHVRTAQVRLARAAPALDWSDHTTLTEALPAIARRAADLRFVQILGTPAPTVTITVDHQPAETIPRAAARHDLDVNTLTSAVRRANLSPATRLDARTPLYRTDGIDRLLRSRRPRQNPAP

SEQ ID NO: 15204 - protein, 338 aa, Actinoplanes utahensis
MPPSGLRISGRNAITDSVCVMKVAVLVYDGVFDSGLAAILDILDGANAMGHEIGGAPTWDVRTVGVRPQIRTGAGHLVVTESLARAEEADLLIVPALAERRPEMLLAHVGGAASRPVRDQIARSRERGTPVASACTGTFLLAEAGILHGRRATTSWWLAPVFRARYPHVEVDQSRMVIASDGVTTAGAAFGHVDLALAVVRAGSPALADLVARYLVVDERPSQSAYTISSALAQSDPTVAAFERWARGRLADPITIADAAKAIGVSNRTLQRCVQRTLGTSPIRFIQDLRVERASHLLRTTELSLESIAHKVGYEHPNTLRVLLRERTGKTTTALRGS

SEQ ID NO: 15205 - protein, 346 aa, Actinoplanes utahensis
MKRRNVLAAAVVAMTSVPLTATRAMAAQTQVETPAEAENTFVRWLSTQDPRAMIRSRARAAILSTPAERTTFLAETYTRVLPDIALTRARQTDYATRMVRTHPAIYYPWVNATGLRALDGAEARIREFSSTDYTAALTKDRDKVPFDTGAAGVVAEDRAFVAELAVSGLSPVARERAARAVTAGTDADIAEFLLYRWAISAEVDIELFRTDYVAAEFGWWTDVRKAVVAAESAEQLARDAVGDAAEPARAAAVRAWEAVGAQAATALAGWAAHQRFTQVQIDDWQRTATTAAASTSPTWRLLKVDAPAVRKLWLAEQANAAARTAWWTAVNENARARVAALTTPAV

SEQ ID NO: 15206 - protein, 223 aa, Actinoplanes utahensis
MTSVFQHALGDDFGRLHPRLQRRFGVDGERDQGCVGTGVMERVWRGGAYTAPFLHLGTLRHILFPETGAGIPFTIENYAYRDTYGRPTLTFVRTFQVRPHRRRRFDATMVYHPGRDVIVDYLGTTQHLAVDLDVSVDATGALHLRSGPQLFRGGVGCPRFLTGDAEVHEWWDERAERFHIRVKVTNRHFGPLFGYHGTFTTAYVPSGAPVPAAVRPLREACPR

SEQ ID NO: 15207 - protein, 218 aa, Actinoplanes utahensis
MARIYVETTIAASMDRVWLATQDHRQHPRWDARFGRIDPVPGSTPAAFTYATAVLPGVEIAGYGVHSGERQQAGGAVSALRFGSADRRSPIQEGSGYWRYVPVPGGVRFLTGYTYRTRWGRAGRLVDLVFGPTFGWATAWSFDRLRLWLEHGITPERARLYTALELVLRAALVATAGLLDGRPAVVLVAALLAIGLPPHPHTPAARRCRRRPEQENPR

SEQ ID NO: 15208 - protein, 287 aa, Actinoplanes utahensis
MILRRQPDAIHRRGDGRLDVDPCHDTSLEFERPLKPSSFERMLNGGRRWLAGRRAMWPPRVQDDRRPLSIRSRSRNPFRDSCSSVPGPGRDPALPLPRRRRHTPIPARDRSLDRPRLRRATLLDPRPRCRRRDLAQLARPGRRTVAPGPKPGPATGHPAHPGATVRKYRDSTPRWDVPDWALLSGSRTVAGLALIAAGEDDTEFAYASSNFWSNLHHSLCRANPTPDWPLLTRFRRLEDTARHRELTRLHTEPDATEVVRSELAAWSPHEPVLRAVATAIVDAVTRR

SEQ ID NO: 15209 - protein, 287 aa, Actinoplanes utahensis
MSKKKQHAVLAGVGVAVSALTGVATNVLTGGKASWTLGAVVVMLVVAGVVLAVLNSRLEHRMAEEPPARPDHSGPAPAAAEPRRQPAGGVSVTSAGDDSITVGGNYQNSGMPAGYVVLSLVVVAAVAIGILVVALRFARPSTAGPSSVNTTTGTTTPVVTAAPAPEDLHYDVAATRNRAREVRIKAMAYGQPEPGLTYWFFVDVDYGNNYVEYYPRRQLTGRTTSFDVVLVEDADLKYSRTGRIYGLTGAVSDEAAVKLKRQETTRKNDFFTEPPGQPASDAVTLPF

SEQ ID NO: 15210 - protein, 207 aa, Actinoplanes utahensis
MTTPIEITVLGASGATGRELTRQALDRGHRVVAIARTPHRIVAPDSPRLLRVAADVGRPDQIAEALRDRPIVVSALGVAKGDRPGALTAGARAVAAAGPDRVVWLGAFGTGGSAAVAGPLTRTLLRMLGDLDDKVTAERIILAAGGTLLHAGPLSDGPLSPDRWTAGLDEVPRRLFPARISRATVAAALLDEAEKPAPGPGIAVPLG

SEQ ID NO: 15211 - protein, 260 aa, Actinoplanes utahensis
MTSDQQLLAAATAAVRAAAARVSRPERTPVTEADLVAALRANDDAVTATLRPALLAALPGAQWTADEHGSGPMPGGDWWVVDPVGGNMNAVQGMPDWNIGVSLVRDGRPVLAVLHAPVAGETFTAIAGGGAWLGGEPVRVSGKTDLGLALTGTGQAKPGRDAAAADRAGAAVAAMMRHALYVRASVPVGHQLTQVAAGRMDVHWQFDNLRSHIAPVLIVREAGGVVTDLDGEPWQITSDSYLAAAPGVHAAALDVLRPLR

SEQ ID NO: 15212 - protein, 305 aa, Actinoplanes utahensis
MQLDLNLLTVLDALLEEGSVTGAAQRLRLSSPAVSRSLGRLRRLTGDDILVRTGRTMTPTPYATAVRQRVAELLRQSREVLTPRGALDPSTLDRVFTLQCHDALATAVAPVLLADIAERAPGVRIRFLAESALDTDELRHGRVDLEIGATLPATPGIRHETVGHDRFVAVLRHGHPHAKHLDLAAYAALPHILISRRGRLTDPVDTVLETHALQRRVLASVGTTAAAAHVIAHGDAVLTAAELTWRPLLRAFELVGVPLPFSLPAPPVICCWHQRYDTDPAHSWLRDRVSAAFSTVLADDQAPLG

SEQ ID NO: 15213 - protein, 101 aa, Actinoplanes utahensis
MRRSRPAYRAGVWLYRLAFVVAAVYVLAMATHALPVLSGPSLAFFPILYLACLVAGQYLFAQVGMRIFALALVRTDGPVGNSDEVRAHRRTVFRDVFGRGR

SEQ ID NO: 15214 - protein, 499 aa, Actinoplanes utahensis
MPTFRDSVLRTKPVEDVLAQASAEAGDDGPRLRRRLGPLDLMGFGIGIVIGTGIFTLTGIEARDHAGPAVTVAFALAGVASLLAALCYAELSSSVPTAGSAYTYAYATLGEIFAWIIGWDLVLEFALGAAVVARGWSGYLAQLFHLPGAIFGESSTVNVGAILITLLLGAVATVGIRQSSRVTNVLVAVKIAICVFVVVAGAFYVKGANLTPFVPAAEHPAGGESGLARPLTQLLFGVAPSTYGMAGVLTAAAVVFFAYTGFEAVANLGEETRRPRRDLPLGLFGTLGISALLYVAVSFVLVGMVDYRSIDPGAPIASAFAAVGAGWAADLVSIAAVAGLTSVILVDIVAIGRIGFAMSRDGLLPAAVGSVHPRWGTPYRTTIVVTVAVAAVAGFVPLSSLANLVSIGTLFAFVVVSVAVPILRHTRPQLNRGFRVPLSPIIPALSALACLYLMTNLSGETWVRFLVWMAVGLVVYLTYGRRHNRLSAEARGARTGYRP

SEQ ID NO: 15215 - protein, 149 aa, Actinoplanes utahensis
MILVVEPSPVALAIRDMLQANGEATHSLAARLGIGVTDAVALDHLIASGDGLGPTELGQRLGIRSASATTLVDRLQAAGHAERVPHPSDRRRQSVVVTDQTYRQVLEALAPLFDRVEQAAAQLTDDQAAATAAFLHQVAAAMREYAAGR

SEQ ID NO: 15216 - protein, 529 aa, Actinoplanes utahensis
MTAEISPRRRWLGLLVVSFGVAMIIVDATIVNVAVPSIIDDLGATSSDAQWVQESYTVVLAALLLVAGRTADRVGRRRLFMTGIGVFMLGSIGCALAPAPPLLIVARQVQGVGGAMILPTSLSLLNAGFTGRERGIAFAVWGSTIGGAAALGPLLGGWLTTAVSWRWAFGINLPLSVLILIAAPMLLAESRESGDRRGNDRAGAVLSSLSLGCLVFALIEGRSFGWFERTGPVSVAGVSWTLRLSPVPIAFGLAAAGLVTFLWLEHRRNAAGRPVLLDLRLFAIPSFRNGNLVAAVVSLGEFGLLFALPLWLQNVRGYSAFQTGLALLPLAAGSFVASGLAIPLAAKRGAIFLVRLGIVLEIAGVAGIGLVAAPDTAWWQVTPLLFGYGVGVGLATAQITGVVLADVPVAMSGQASGTQSTTRQLGSALGIAVLGTILFSTLAGHLSSALDDRGVPAQQRSAVVAAVKDSAGAAIPGLAGDPRTAPLAADAKQALSTATRWTAFTAAGFLLIGLLASARLTRTTPGGDR

SEQ ID NO: 15217 - protein, 339 aa, Actinoplanes utahensis
MIDDFLSAQRDVLAEVSDDCAPLERYVADLMGGGKRLRPAFCYWAWRAAGAPDGPGIVAAATSLEFLQAAALIHDDIMDDSDTRRGAPAVHRRLAALHSGGRWAGDADHFGLSAAVLAGDLCLTWSDALYSGSGLHPSALARGRPVFDRMRTQLMGGQYLDLLDQARPSRGGVDRARRVVHFKSAKYTVEHPLLLGARLAGADDDLLARLSAFGLPLGEAFQLRDDLLGVFGDAAQTGKPTGDDLREGKRTTLVILAADRATAPQQAALTALLGDRGLTGAGVDTLRQIIVDTGARAEVERMIEQLLATSLGVLSGTPVDEAARSVLLALAEAATARSS

SEQ ID NO: 15218 - protein, 78 aa, Actinoplanes utahensis
MPARYRGVAAAVELSSLLILLINLATVHARPVTSLGGPIHGCAYLFVIVSTATDARASRTAKLLAWVPGIGGLLARRR

SEQ ID NO: 15219 - protein, 157 aa, Actinoplanes utahensis
MGNLASSVRADPALTFAGVTKLLLSVHVLAALVAIGPVTVAASMFPAATRRADRGALPLLHRICRMYALLGLAVPVFGLATASRLGVLGDAWLLTSIGLTAAAGLLLALVILPAQRGIVAGAAVPPARLGMLTGVFNLIWAAVVVLMVVRPGSTTGT

SEQ ID NO: 15220 - protein, 311 aa, Actinoplanes utahensis
MAVLALDTVIPFDLATPIEVFGRTGHGALYEVRICAPTSTVDAGAFTINTRYGLDTLLEADTIIIPGCADTAMIVPPEVVDHLRKAAAGGARLASICAGTFILAATGLLDGLRATTHWLATGALAARYPEITVDPDVLYVDNGQFLTSAGAAAGLDLCLHLIRRDHGSAVAADAARLSVMPLEREGGQAQFIVPAQPPAPRGSVLEPLLRWMQDCTDVEVSLADLATRAGMSVRSLNRHFRDQTGTTPLQWLLRARVRQAQHLLEATDLPVEHIAGRVGFGSPTAFRDRFKRVTGASPQSYRAAFRTRPRP

SEQ ID NO: 15221 - protein, 68 aa, Actinoplanes utahensis
MALNEQEIISSDPAGQDGEGPADGGANPLGRDGGADGGAEKEKPHGEGLADGGANPAGQDGGADGGAE

SEQ ID NO: 15222 - protein, 61 aa, Actinoplanes utahensis
MTSPTTVCRSISRPGGSGTVYTRTGNWLVNVLVVFLIVGIKSLFWGYAPAYGTQRAGNHQL

SEQ ID NO: 15223 - protein, 615 aa, Actinoplanes utahensis
MTCWSRRPERTVPAGARRLRSVAWQVWCVVAVALIAAHFIVPATHPVAQSVLYCAVSAGTAVALAAGIRLHRPRNAVVWWLLAIGQAMYVAGDIAYFTATAAAGTNGYPLFANALYLSQYGFAGAALVLLGRRRSPQRNTAAMIDTAILTVAAAVLWWVFLIHPAVAVPGSSPLDALGATIYPVADLCVLTVAIRLLLGGGTRQRSYLLLLINLGLTLLADTAYGLLSLHEVYVNGGWSDAVYLAAYVALGASALHPSMRHIAEPVETRSGATLNRVALLALATLMAPAVLLVQDLRHSTSSDLVVVTASAVLFLLVLTRMAALVSAQRRIAMTDGLTGVHTRRFLSEALSAEGDRAARRGTPIAMLLLDVDHFKRINDTYGHPAGDQVLVELARRLRRACRGTDVVARFGGEEFAVLVTRDHADLATLAERLRERIAEVPVVVNGRTAIPVTVSVGAAALPGGAGTEELLSAADAALYAAKRGGRNRVVVGGTGHAVATGDAVLPDPAGAPGPDEQIRRWTATVAEAARCRAADPVVPTSLLIGVCAAWAVMRRPGAGRAGLSAEQARDQLRRCRGVQFDPDAVDLFLELETAGLVGVPDPATTGAAHEEYAVS

SEQ ID NO: 15224 - protein, 71 aa, Actinoplanes utahensis
MVVPDFDRFCRTRGADGAALDGGTVYDWHCVTGGTRSAIDVLAACRETTFGYATVDRFADFFDARSWQCRV

SEQ ID NO: 15225 - protein, 40 aa, Actinoplanes utahensis
MRTLVRLLLTLLTGAVTALAGTAAPAAASPPRRGTWARRT

SEQ ID NO: 15226 - protein, 265 aa, Actinoplanes utahensis
MPRTIAVIILASAATLAALAGPAQASTAVPSTAVPSTAAPVIHFAADGTDRVDGAIEAGRPVIVDYDLSRLPECRNQYAGGDAWSIGVYYRVDGGPIQTRPVTRLDQNRHNVTAPAGIDLPPGGHDLELWFHAGDRAGCSEYDSRSGANYHYPIGQPAVVTFRADWSETVTGSIEAGHRLALRYDTARLPECRDQAWRIDVFRRFDGGPAQSETLTTGDGSQVPGSIDIPAGSHQVEIWFQVTADQGGCTAYDSDFGANYVYAVA

SEQ ID NO: 15227 - protein, 311 aa, Actinoplanes utahensis
MRTVVRAGAVALAAGTLLLGNAVTAQAATTGKVTVKVDRLILEPGRYGHTGTIRIVIKNGTDQPVSGGNLTITEPLPASFTTFDGAGGCTLDVGPDGRETDYCGLEQTIQPGQSGTVTIGFTSPAKPQKYAQIAPNVGTVEYAGSKVRYGAVFRSTTGSLSRPRVYHQDTESKLTVTADAGVTLTKQEDGTFAGHLPITVHSDGDAPHKWLHADIITPAGVSPWPMLDPSGPCVGSSDDLPIPAGGAGEGCDLFGVRIAEGETQTYDLRVRAPEGTAAGSLGTVTTRVQLGAGPAQTDGANLVAFAVNVAG

SEQ ID NO: 15228 - protein, 283 aa, Actinoplanes utahensis
MQTPGMTIVVFGARGRVGRQVVAGLRAAGERVRATGREAPAGAFGPEVETVAADLDRPETLGPALADAGAAFAYAHPAGAEGFAAAARSAGVRRVVLLSSAAVTRPDAAQNPIARRHRAVEEVLERSGLEWTFVRGGMFAVNAIGLWGPSIREQGRVRLPYAEAQSAPVHEADLAAVAVAALTADGHAAMAYTVHGPESLTLRRQVGAIAAAVGRPVAVEEVDEEVARADMLRGGLPEFAVTAILRNWSTGAAAETSTVVPQVTGRPARTFAEWAVDHAADFR

SEQ ID NO: 15229 - protein, 271 aa, Actinoplanes utahensis
MADDGDLSARIDTTVPHPARRYNYWLGGKDNFAVDRASGDEIEAKFPGMRAGVVANRDVLGRITRHLAQDAGIGQFLDIGTGLPTADNTHEVAQRHAPHSRVLYVDNDPMVLTHAAALLTSDPRGHTRYLEADLRDPEKILASPELAATLDLSRPVALMLIAILHFLPDRAQARAIVRQLMDALPSGSYLAVTHFTTDFLGEQQRATYRAMLDSGRSDAWPCTRDEFAGLFDGLDLVEPGIAVASEWRPAPGAGAVDPSLVSIWAGVGRKP

SEQ ID NO: 15230 - protein, 153 aa, Actinoplanes utahensis
MVRGCPPALCSRPVSDLLKEHVQSVLEANFASVNQTRRRIEDLEAQGHRIITGGQIGEDGWDIIDWRTSEILAAGDGGLPEYEAAAADLDPDDKFIHHDRILEDEDLEYVSTPGLPDGLANAVEDWVLTADADEVAEFIGWPVEKVEEYQAED

SEQ ID NO: 15231 - protein, 211 aa, Actinoplanes utahensis
MPSTKPLREGSATKRAAILSAARELFLSDGFDRTSVDAVSARAGVSKRTVYDYFGDKNTLLQAVVGDISDSLVAAVRRTIDATLTGLTEPAQLQDALTGFSMRIATDMLGSADYATLLKLLGGEGHLSEAPFRDAPEEALAERLAVLGEAGLLTVADPRLAADHLIALTFGVVLNRHGSTLITADERVRSLVAEGVRAFLRAYAGTRATAP

SEQ ID NO: 15232 - protein, 381 aa, Actinoplanes utahensis
MKALVSGAGIAGPTLAYWLRRHGWDVTVVEKAPAVRGGGYPIDVRGTALDVLDRMGVLPRARAAHIDTRQLTFLSPDGRVAGRLRPRNLSGDGLELPRGVLTTILCDLVRHDARFRFGDSMAAIDGRRVTFASGAQEEFDVILGADGLHSATRRLVFGPEESFSRHLGYVFAGFTLPNDLGLRHEGQVWSAPGRMATLYAPGCSDTVHGLLMTRSPEPPRDGLRLLESAFAGDGWLVPRLLDGLRTAGDVFLDVVSQIHMPTWSHGRVALVGDAAHAPSFFSGQGTSIALVGAYVLAEELATHADPTAAFAAYEQKTRDFVRRNQALADGGGGTLAPDSARALWFRNHVLLKAAPLLGATGLLGRSVRHAATALRLPAPVH

SEQ ID NO: 15233 - protein, 243 aa, Actinoplanes utahensis
MALIAYDNEQAAAFEETRHLQDDDLATWRAAIGRHFEPRSGARLLDLGCGTGSWARAFRTWWPGVEVLAVEPSAAMRERAMFQPVAAGAADDIPLPDASLDGVWLSTVIHHVPDLEAAAREIRRVLKPGAPVLIRSAFAGRHEAINLFRWFPEAVAVLDRYPSIPGVEAAFATAGFATTGCEPVPQVTAPSVADAAAALRREAHTPLQLISDEAYAAGVARLREAARTESGPVVDALDLLVLR

SEQ ID NO: 15234 - protein, 336 aa, Actinoplanes utahensis
MSTTRTRAQPRSIFASASRTSTATTSTATTTSTITAPATTSPTPAGSLSSRSGTGPADDHEDHERRPGRGIGLPAPGVYPAAMVISILGWVARRRLAVLTAALLTAVALQVVLHVTGTVFAPWASFAVYALPPAALLLCMAVAIRVHDAAHLVARPEIPAFGSPPNPTLVLGAACLTYLAVYGAAGGIRSIEPHPDLGHTIVSIALYLTELAVFWWASRLRTGISIRPDGILDRQPFGDLFIPWDALATPIAAQPHDAHRVTLHLAHPDLTRRRGLRRGAPAALSAAGVRTDLLAWMINHYADQPADRSAIGSPAALTRFLLPLDRLATPEVARQP

SEQ ID NO: 15235 - protein, 156 aa, Actinoplanes utahensis
MTDWRADRTGSALRGQNPTVLARLTAGFAVIGDSQFLPGYCVLITDDPAADRLTDLPRPRRLAFLADMDLLGEAVATVCHRHDPRFRRVNYAILGNLDPFLHAHVHPRYDWEPPDLINGPATHYPADFRNAADNLLGPRHDVLRADLTAEIHRLAS

SEQ ID NO: 15236 - protein, 165 aa, Actinoplanes utahensis
MSDPLRRSARVLLLSSTDRVLLLQFRFDPADAAKGHGWATPGGGVQDGEPLAQAATRELHEEVGLKVSPEVLGDPVAYTSGFADLGWASGIFRDEFFAHRVDDHEVDTSGMEDHERGYHAGHRWWTVDELATTTETVYPFGLADLVERLLTEGTPAQPVQLPWHH

SEQ ID NO: 15237 - protein, 192 aa, Actinoplanes utahensis
MIVRRLAASAVLALAAATVFVLRLGDHPAPQAAAAQTETTPSGIDVHYAQMMVDHHEQAVAMSRTLLAKGGVPERVRLIADYIIHDQQREIDETTDWLSAWNEPSPSAGGPAHGMLSPAQLTELDHASRDAAPNVYLRLMIEHHRGAITMSRSLLDGPSGNPYIHSLAKHVLNEQSSEVDAMAALIRSDSPS

SEQ ID NO: 15238 - protein, 436 aa, Actinoplanes utahensis
MAYRKFAGVVTLMTSAALGLTVPAQAAPAASPCGASSMVKETLPNGTTWQLCWRINDKAGLVLDHVFVATKRYPAPVQVLDSIRLAQLNVPYDTGDTEYDDLTQIGLGSYGLETLTGDDCKGGSIRLGSDGSSEPQRRKVLCVSAEPRGLAYRLHSWDDGGAGPSAEPQDKVYSQQGHDLVLRTVSKLGWYEYVTEYRLHDDGQITARLGATGDLAPSEYSTSSTGWPIGKGPAKDYATMHYHNAFWRVDFNIAGKGGEKVEQLDTTTAGRGSVTAKLKTTRTAVTNEGTFTKVNQRSWRLVSPTSKNADGHQRSYELALGATDQYQGHPETKPDVTFTQKDACEKWASDNNSDPECPLDKKTIIDFAKDKQKLTDPVMWVRVGFHHIPRDEDQSPMPLHWQGFDLLPRDFTEMNPLTPPGLAGANGNTSGDGSQG

SEQ ID NO: 15239 - protein, 243 aa, Actinoplanes utahensis
MDRYRKWAWGLGIATVSAASAFGLAAWGASAAPTAPPTTGAAAGQAQVSDPSPLPEAATGAGSDPLTSAEVDRARAAALTPELAAKAKDVTGKAGPEYLAAELDTDGTGRQAELYYYDYGTQKLYKQVVDLASGKLTKSYAATGMQPPASEQEAKVALDLLVADPLGADFKTAYRKATGQDLHGTDGLVPTAHVYTSKPADRGATQCGKSRCVQLIIKTSDGHFINVTDVIVDLSGRRVARLK

SEQ ID NO: 15240 - protein, 302 aa, Actinoplanes utahensis
MTMQVPYAGGRLDRAAARRADPRWLAEVHSRPDVRVVPIWRDECVVHGTPARAIVAAGPAARRLLDATAEPVFLGLDDGAGIFAVDLSEYDSGTAVALAGGDATASVRSVYSEHTPAEAATLGYARGLLRAIRDQRHCGRCGGPTEPRHGGHVRACPACDRLLFPRIEPAVIMLVESAADPGRCLLARHRGSASGEYSTLAGFVETGESLEDAVRREVAEEVGLTVGTVAYAGSQPWPFPAGLMVAFRATAIDEVPTVDGDEILDARWFTRAELAGRAAAGRLGRVDSIDRLLLHSWLDHNG

SEQ ID NO: 15241 - protein, 402 aa, Actinoplanes utahensis
MREGGDKVLLGGTVMGIRPRFGTLLTVLVLAGAAALEGCGGDHAATSGASAPAAIRLGALVPLSGTNAQSGREMRDAAQMAVDEVNAAGGVLGRKVELLVSDDACDPGTAVVKANDLVAQDITVSVGGYCSSATVPTLKVFRDAGVPMVIALATSTDLLVPKYDSVFLISGTVTAEGVFAVAAMRRMGSKRLIIVNDGTSFPVTLGRTTADAAAKPGTGIETVATHELSQGAPSYARLARQIVGEKVDTVYFTGYYGEANQLIRDLRTAGFDGRIFVGDGATDGPLLTNLTAAQTRNVFGTALMVPTLMPSLAEWSKRFEKVTGRQPGAGGPESYDAVTVAVDAIKRAGSVDHAAVRAAIAATPDLPLLSGKVKFNADGTRENPVFLLLQVRDGKLVEIPAG

SEQ ID NO: 15242 - protein, 679 aa, Actinoplanes utahensis
MKRWRMPSGPAGRRSSVRDGSRGRRRVSLNTTAALASVLLALGAYTIIGTALTAQAVHDHSRALQVDADFSEARGAITLEEVNLRHYQVEPSSAVLSRFLQAAASVDVALHLAVQHGLPDADREAARLLDRQRDYRTNAEQLIALVADRDPDSFSVDSLSVTPSYYTLQQDVDAVSRAYHASAQRQADAMQRAEVRMLIGTSVGFGVGLTLVGVIWRLVLSYQRRLVQDADASEHRSLHDPLTGLPNRRMFHERLTDSVRVSANRRDDQVAVMIIDLDGFKAVNDTLGHQAGDQLLQEAGHRLRAGIRDGDLAARLGGDEFAVLLSGVTDLATAVEVAERLSDKIRHDFLLDVGAASVSASIGLALGTTDVADDELLRQADAAMYRAKAAGGGVAVYDALLDAVAPEEMSLFGELRALLDSGDPENQLELFFQPQIRIADGSVAAVEALVRWRHPTRGLLLPGAFLDMAASRGLEIALTYHLLKVAVAQADRWAAAGNPMAVSVNISPRCLLHDDFLTQIRDAVTGVHLPHGILQLELTESSVMLEPDRARTVLRQVREEGILISVDDFGTGFSSLSQLRQLPADELKIDRSFVQGLARDVDGLVLVRSAIDLGHNLGLSVVAEGVEDLETLAVLREMGCDLAQGFALSRPVPADEVPAACARASQAAGQQRVPQPHAG

SEQ ID NO: 15243 - protein, 349 aa, Actinoplanes utahensis
MRCRPRAPGQARRPASSGCRNHTPGDRYADRVTRTLTFAITLIQLYHAALPLRLRRQRNKSRARDSNQHVASGQDRHADPDDSERVCRKPTAAVRGFCLIDGVPLVTTLAPMEAEGEAALGRLLAYRRPKLAATAGTVRPELKEVLQGGALTDALVRRLAPALGWRTADLFVIAGLDLPRDLVPANGTKPWDVGSILEKAARLAPQSLRRLHEFVRSLPERPPAWPPALPRHAYPLGPGEMMLRLLRNRNIRPYSPKVLYFIGNGPIVSHSTMAMLGPGRTKLTPQYVTAFATVLGIPADELAAVTGVAAAVDPMLHGNHAELAELAWAARRLDGNQLAEALELATELR

SEQ ID NO: 15244 - protein, 212 aa, Actinoplanes utahensis
MGDFLKTTLARVPDGFDLPEPLRLLFAWVDEQGFVVKGHDGDLYGSLSDNGRVGTSIELRGYTDEQTLSYARSWFDDSVPDAAARLWPFAQTGGEGSMAALWRDGEGRVRIVHLGSGSGSIMTCVLADDAVDFLRLLAIGYREICWNEEFGAPPEPWDADHEVVNAPYRDWLNRTFGVTAPATGLEIVSEPAEMGDEDTTDPFCRWVDNRDA

SEQ ID NO: 15245 - protein, 448 aa, Actinoplanes utahensis
MSFHDKVVVITGAGSGIGRALALELGRRGARLALSDVNDAGLKETAERVNAPVHTAYLDVADRDAVEAYAAAVAAHHGVVHQIYNNAGVSGGGQTILDSDWASFDRTLSINLYGVIHGTKAFLPHLIASGDGHVINVSSLNGFMAQPTLGPYCASKFAVRGFTEVLRTEMLHAGHPVRVTVVHPGGVKTDIASASLRHAEEAGLSPSADQRARARTYNEKLLNCLRSRPHGSSPTAWRPGNRGSWWAATRNSSIGWCGCCRAPTRGSSPVTNADCSADQDRTGDQDGRDDRAATTAAAQHGQRPHPGVNELQRRPGNVEVVVGHHSWTRREDDSCTGAHRGQRIGQGVSAAVVARPLVCKIVVTASSKPTVSSITCSPGTPSRSRSVYHARIIAAVTGIGGSRRSCRRTVSSKPTCIQKVAAGPGCSVTRARSRGPYEPADRMPSRIT

SEQ ID NO: 15246 - protein, 492 aa, Actinoplanes utahensis
MCWRNRLGARILYCVEHIDVLIVGAGISGIGAARYLTTELPGKSYAILEARGASGGTWDLFRYPGIRSDSDLHTFGYEFKPWRDEQSIADAPRILDYLRETIAENGIEKHIRYHHRVVGAAWSTDDARWTVSVDVDGTSLEITCDWIFSASGYYRYDEGFTPSFEGRFGGTLVHPQHWPEDLDYAGRRVVVIGSGATAVTLVPALVDGGAARVTMLQRTPSYIMPVSKKDPVANALKKYLGPERGYAWTRRKNIAQQKAVWSFCQRYPKAARKLIRWVNARQLPPGYPVDEHFNPPYDPWDQRLCAVPDGDLFTAIRGGKAAVVTDRIVRFTPGGVELASGQHLDADIIVTATGLNVQAFGGVPVSVDGVPVALPETVAYKGMMLSGVPNFAYAIGYTNSSWTLKIGLLCEHFCRVLKHMEAGGYRVCRPLVADPAMPTRPFLDFGAGYIQRAVDQLPRQGDRMPWLTSMDYQSDVKLLRGDDVTDPELHFS

SEQ ID NO: 15247 - protein, 394 aa, Actinoplanes utahensis
MSPRVAELFRQGAQAALDAEAESVEAVHEASLSGDRMRPVADDPVLVAAVRRSNVANLRQWTEANVRAPGRRVPANLGPEVLETARDMVRRGLDQRALDSYRTGQSVAWRRWMRICFALDAEPDELRALLDVSSLSISTFIEDTITAVSARMEAEHTELTRGAHAERRAAVSLLLEGAPISRGRAEAQLGYRLTGPHTAAIVWTTADTATARLEAAAEALTRAGGATHRLTVLAGAAALWLWLPVAVAPRMTDSGDPDVRVAIGRPGADVEGFRRSHLDALATQRMLTRLTSPQRVAHYADIQLAALLTIDPAQCAEFLADTLGGLLHADAETRETVATYVREQCNTLRTADRLFTHRNTVVRRLARADALLPRPLADNVLAVAAALEILRWRG

SEQ ID NO: 15248 - protein, 146 aa, Actinoplanes utahensis
MRFMVITKATTASEAGVLPKTEDFATMGAFIEELVDAGVLLAAEGIGPSSTGARIYFDGEKKTVVDGPFAETKELIAGFWLVEMKSLEECVEWFKRCPIQKTAGEPTNIEIRRLYTAADFGDELTTEQREAVARREEKADPSYRSA

SEQ ID NO: 15249 - protein, 430 aa, Actinoplanes utahensis
MPTDTHRAIETVWRIEAPRLIAGLTRLVRDLGTAEELAQDALVAALEQWPVQGVPDNPGAWLTTVAHRRAIDRIRRAETYRRRVEEAGRDRKDSAPDVGTLVAEDDGIGDDLLRLVFIACHPILSTEARTALTLRLLGGLTTDEIARAFLVPEPTVAQRIVRAKRALAKARVPFEVPQGAELAARLSSVLEVIYLIFNEGYAATAGDDWMRPALCEEALRLGRVLARLAPREPEVHGLVALMEIQASRAAARTTPDGEPILLADQNRARWDRLLISRGLSALRRADELHAGRPGPRESRTGKPGPYQLQAAIAACHARARRFADTDWVAIAGLYERLAEAAPSPVVELNRAVALSMAYGPAAGLDLLDQLAAFPVLDGYHLLPGVRGDLLARLGRHTEARAEFARAASLTRNERERTVLLNRAAACERLG

SEQ ID NO: 15250 - protein, 202 aa, Actinoplanes utahensis
MFALEGSIAITGSLVQWMRDGLGLIGTASEIETLAGTVRDNGGCYIVPAFSGLFAPHWDSRARGVIVGLTSYITKAHLARAVLEATGWQTRDVVDAMNADAGLALTALNVDGGMTADNLLMQIVADFLDVPVVRPMVAETVSLGAAYAAGLAVGYWSDPRDLRANRHHAGRWTPAMDAGRRAAEHRRWRRAVDCAVFFGRPD

SEQ ID NO: 15251 - protein, 77 aa, Actinoplanes utahensis
MSFVLAIDQGTTSTRCILFDRRATVVGVARAEHPQSYPQPGWVEHDAARIWRDVRRLIGRVLREAGVTEVAAIGIAS

SEQ ID NO: 15252 - protein, 259 aa, Actinoplanes utahensis
MRATMSHVPGLIQSIARSSAVLRLLAAGDDRLRVKEIADALGMAKSTAHSILRTLEHVGFVEQDPRTARYRLGRGLHDLGAPGIDANELRGRALNWADTLAARSGEQVRLGVLADGQVLVVHHVFRPDDSAQSLDIGTRLAPHATALGKVLLAYSAAATRAAVAGGLTAYTRRTVTDSGALARALAATRAGGWGLSVEEWRPGLAGIAAPVRASGGLVIGAVGVAGPVERLTDTRRQARPALVEQVVAVARSISREVQA

SEQ ID NO: 15253 - protein, 80 aa, Actinoplanes utahensis
MGRYVGAIDQGTTSTRFMVFDRSGAEIGRCQLEHRQIQPRSGWVEHDPVEIWENTLKVIAGALAGTGLTPADLAAIGITS

SEQ ID NO: 15254 - protein, 156 aa, Actinoplanes utahensis
MPAFSGLFAPYWRPDARAAIVGLSRFHTAAHLTRAALEAICHQTRDVVEAMAQDSGTALDCLQVDGGVTANALCMQLQADILGVPVSRPAVAETTALGAAYAAGLAVGFWSSPAELRANRHEDRRWEPTWPADRRTEGITRWRAAIDRTLDWVSVG

SEQ ID NO: 15255 - protein, 571 aa, Actinoplanes utahensis
MKTGVISPESRRRALAAMTSGELDVLVVGAGVVGAGSALDAATRGLSVGLLEARDFASGTSSRSSKLIHGGLRYLEMLDFSLVREALRERGLLIQKLAPHLVRPVPFLYPLQRRAWERLYVGAGVALYDILALSGGGAGVPVHRHLSRLEALKAFPSLRPETLVGAIRYYDAQVDDARHTMFLVRTAVANGAHAASRTEVTGFLREGRRVVGVRARDLETGAELEIRARTVINATGVWTGDSQALLTGERGQFTIAASKGIHLVVPRDRIAGHTGIILRTATSVLFVIPWDQHWIIGTTDTAWNLDKSDPAASGRDVDYLLDEVNRALAVPLTRDDVQGVYAGLRPLLSAEASTTAKLSREHAVGHPVPGMVVVAGGKYTTYRVMAKDAVDAAVQDLAARVPASCTDQVPLLGADGYRAAWNRRQTLARESGLTVARIEALLHRYGTLLDEVLALIEADPSLALPLDGAPGHLRAEIVYAATHEGARHLEDVLARRTRIAFETPDRGVIAARAATTLLAPALGWSPADAEREVATYEAHVRAELAAQTEPDDRSADATLRALTTSPLTSAV

SEQ ID NO: 15256 - protein, 120 aa, Actinoplanes utahensis
MDDEPEAVEPTPIPPSRSGSAGAVLAIVVLTAFAGYALVLAYLFSWAAGNRCVPDDPGFFCTPTGESLASIVPMIATLAGAICGYTGMSRPPGHRGRLILVGYLIIAGGLLVGRVLVDVG

SEQ ID NO: 15257 - protein, 137 aa, Actinoplanes utahensis
MYEFGESTVIRADLSAVWDTVTDVSAWPAWDPHEQQARLDGPFATGTTGWSKPRGGPATTWRLTEVVPRRRWASECDLPGGTLSGVTAYEPLDDRRIRCTKTIRVTGPLTPLFRFYFARRIRRDMLKTWAALETRSA

SEQ ID NO: 15258 - protein, 177 aa, Actinoplanes utahensis
MTGPDAQSRPGPGPDPGTESMTRPDSGPMLSPGFWLHHAALTWRAELDARLRPLGLTPTQFMLLASAGWLEHVSGPPTQQQVADEAGADRMMTSRVVRTLQERGLLTRSPDPASPPSLRLSLTDAGRAVTRQATRAARDVDTLIFGDAAPHLRTSLRQIAESGGPTRVARPHRPGHP

SEQ ID NO: 15259 - protein, 820 aa, Actinoplanes utahensis
MSQFLSRTRRRLLGAGLTAGAVGAVILAAPLPALAGANIGPWIVMPGGNATLSDQSAAFTGNSVVQLNTSPCPGKLATAGGTGPWNPTVSNRTGTSLTFTVPASGGPAPGPNGAVKLYYACAYDGATAGTSNLLSGGPLYVGAGAAASSNAGLTGGGNPLTLSTGMQNPVFTGYNTVSAVFTTGQCAATLGSTNPANLTVAGLARQSNSTVALTVPSGVVTNGPAPTNYNICLYDGSSAAGSLLSIAGYNANALAVTPGSGSYSASTGVTVSAPGAFLTGITTPAVLVLPMNAGCPGTYSTGQVNGVTPLALTAPGSVRRLTSSRAAVTLPPLTLQQPGQPTTYQICFYSGSTGTSGLIGTTNYTAGVVANPMGINPSAGPPAGGNTITVVGTDFPTDAGRITATLDGVPLTNIQPISDKAFTAQVPAHTADTNLTLVVSTPAGTKALPGAYSYLNTITVSPNTAPSTSPTVDVDVQGAGFVAINFGTGGNAGRVFLVNGVYNGAEVTSGVRANGPVAECVNVLPISDTELVCTLQLNRKLNAQGTGFFDPSAYTNTIASDLSTTAGSRVVVSAAGKFSPNDLGQPIVQGGNANIPPNSLITSVLGPTKVVISAPSPLTGSTLSATIGGAVPAHTFTGSITTTAGSATVSTSSGAFTRADIGRVVSGTSGIANGTTITAVAPGGATATLSAPATASTQYTLSAASTTGGSTTLTSSGLQSSDSGAVIGNNSLGITPGTTVGAVVAGTSATLSAQAAVTAGPADLTLNKPVNANLYAAAPVPDGAYNLVVVSNGAPDAATTDPAYFQTDVTSGSTFTVSPF

SEQ ID NO: 15260 - protein, 329 aa, Actinoplanes utahensis
MGKSGNTGLVRRAQQGDRRAFDALMRHEIPVVYSAAARVLAPADADDAVQETLISAFRNLKDLREPDKLRPWLLTIVMREARRQARDAELPVGLPAGSAESVPVDVQERAVAEVTLAEQRKDISAATPWLDPEDREMLALWWLELLGEVDRSGLVQAAGTSPNHVAVRLKRLRERLTAVRVLVRALAARDRPDGCAEFRVLLAGWPGRPSSVWRKRFVNHISQCPTCGALRHGLVPPELLLSTTALLVAPATLAAQPATAGAIVRVMDAGRRLLHAGKAGIAQPVAAVAATAAVLGGAAVVIARTGESRPLPSAQAPSTTSPRAPVLAS

SEQ ID NO: 15261 - protein, 224 aa, Actinoplanes utahensis
MKRFLRENSLGLVFGLLFLIVLAGEAIAGHADFNQQQLVEGLPPITFGRYLTSASFGADVLENWQSEYLQFFLYIVLTVWLLQKGSPESKELDKPGRETDKDQKIGVYADKDSPAWARATGVRLWLFSNSLSLVMGLIFLLSWLGQSIAGRAAFNERQLGDLQDPVSWSQYLTEPDFWNRTLQNWQSELLAVASMAILAIYLRQRGSSQSKPVGAAHTATGVEG

SEQ ID NO: 15262 - protein, 51 aa, Actinoplanes utahensis
MISAAVFGQQAQVRLADDTIFLGVFPGGWRVLAAGCKPRGDQPYDCTLQGS

SEQ ID NO: 15263 - protein, 254 aa, Actinoplanes utahensis
MDHDGGTRVARVTGAGSPNGIGVAIARELASAGMRVVVTATTGRVHDRAAELGGGAVGLVADLRDRAQAQRLVDAARAATGEIDVLVNNAGMAQTGYADRSAEVGDLDPAEFDRQLAVTLTTCFNVTRLVLPGMIGRGHGRVVNISSVTGPLVSVPGQSAYAAAKAGMDGLTRTWALEGGRSGVTVNSVAPGWIATASSTPEELRAGAATPVGRPGRPAEVAAAVAFLASPKAAYITGQVIVVDGGNLLDERRA

SEQ ID NO: 15264 - protein, 34 aa, Actinoplanes utahensis
MLAVPRQAFSMPYTAWPDGARLLHSLTRSPASSS

SEQ ID NO: 15265 - protein, 314 aa, Actinoplanes utahensis
MRTRLRTILATATALLLAPAVAPQPAQAATTVRLTAMQWNVDGGWKYQTPGASDLLVAKIFDTIKEKNPDFVALNEICQSQYAALTKRLQNETDWPQDKGNFVRFQATRNGTTDDGDVCDHKAVGIALLSRQPLGTANRFALTPNPDFDKDEIRHLLCAPTTTMPVRYCVTHITPKPFGTIGKIQVNEVLSHVEDFEAAGDTVLVGGDFNATPSWPELNVWYDRSVNTPANGDNVGAYREMDDADPYCLGYGEGTTGATTGSPCGTGTKIDMIFFRANHLNGQHAGDALPMSTCGSAPCSDHRLFWGWADLSIG

SEQ ID NO: 15266 - protein, 37 aa, Actinoplanes utahensis
MVVGGPVRLAHDRLRSATGGPARTRVRLSAISAAPAR

SEQ ID NO: 15267 - protein, 404 aa, Actinoplanes utahensis
MIMTGTGLALHATVGMSVLIGLPVTGRAKAAEEHHGAVRRRHRPGTWLLIVIGLLWLNQIAFTIYARRVHGGDLGYLGGYVPQGWFQLADGPVVSWLVAHTPQPQLLALSALRLPSLLELPLGMLAYLTIADWLDPGLYRRLTTPAVVALTSASYSITFGLIEWAMHTTYTIEDLVLRFVSGVLTAVALIRLGRRPSAPPGTGAPRTAHEFLVFAASTAALGHLILGLYDSVLLYSLGRLPAHLPGMIADVVVIAAARFAAARLRRRPVTVTGPGLDTLITGLSWWLALFLIPAMAIRYELGFGSRLFAAAAGLLVIGVATAVALREVHDRLPLSGRPAVTRRWLLGLGVAGVPASVAALIGFGLRVPGRQEIHLLTAAGLFVLTATVVSASWDRRWFTVPARH

SEQ ID NO: 15268 - protein, 787 aa, Actinoplanes utahensis
MRAGLDTSYSHSLISLFTGDSVLSRKIGIWVGLWAVVMAVAVAGPATAATRHFYVALGDSYSSGEGTYLDDSDYDAGTGGDCHRSRLAWGRVLAADTSLGLTMAAGRNSIAGHLACSGATVKNIRAISQHTGLGTQLAQLAALPVRPDLATVTIGGNDADFAAVVRTCYLYGGLKCTQAMATAKTKIGLLGDCAANDDSLGRYCLRDVYRDIKQQISGGRLIVVGYPRLFATGYRADGRCLWAASGVLAKLDGLIADMEARVHAEADAAGVTYVSTWDALSGHELCTEHSWVRSITPASGQKSLSAHPLAQGQQAMAGKVALYLHNHPFPAEPSVPTPTPTPTPTPTPTPVNRAPVAAFGYTRLSGAGNRVTLDGGASADPDGSIATWTWTSGGRQIATGRTATVSFAGVAAPSVTLTVTDNRGAPGTVSRTLSLQNRAPRITGVTPRAGAIVGSTVPDLAVAATDPDGDDLSTTFRVTGPAVDVSSGPVGATWTVPAHRLDPGARYQVAVTVRDPSGLTATATTSFTVAMLPTAADVTATSTGNGYWQVDTYGGVFSYGDAPFHGSLPGLGVKVNNIIGMTRTPDDGGYWLVGSDGGVFAFGNAPFYGSMGGKPLNGPVVGMAVTPSGKGYWLAAADGGVFAFGDAGFYGSMGGKPLNKPVTAIGATASGQGYWLAAGDGGVFAFGDAAFYGSMGGKPLNAPVVDMDVTPDGGGYWMTAEDGGVFAFGDAGFFGSMAGQPLNGHITGMSVTPSAGGYWLNGCDGGIFAFGDAQFHGSNPTYQCRGN

SEQ ID NO: 15269 - protein, 204 aa, Actinoplanes utahensis
MGEDGHAAVRDAYSALSGVYIDLFGTVEQSHPDDVAFIERHLTIRPGRVLDLGCGPGHLTGLLRSRGVAATGIDMVPEFLAYARATHPDGDYRQGSLTSLDVADESVAGILAWYSLIHLPPDALDAVLDGFRRVTAPGATLVVGIFEAPELGPFDHRVATAYRWPVDAFSARLARAGFDEVERQRRPADATTRPLAALAATRRA

SEQ ID NO: 15270 - protein, 318 aa, Actinoplanes utahensis
MRSGAAAGYSGYFHESAFYDSDERFLAVIVPFFTEGLAAGEPVLAAFDAGRQELVREAFGPRSGIRFLDGATQYRRPAGAIRRYREIFGEYVAGGAAQIRVAGDVPQPANGAPWDWWARYEAAVNRAYQDFPVWGICPYDTRTTPPEVVAEVRRTHPHVVAGGGHAANPDFEDPAEFLRARAGSWRDPLERRPPDLELTDPTTPQARAAVRAVAAPTRLRAEDLDNLLLAVTEAVTNAMLHGRPPVVLRVWAAPRRLVATVTDAGTGPPDPYIGLLPADRAVGNGGLGLWMSHQVCSFVGMHRGPEGFTLRLVAGDLD

SEQ ID NO: 15271 - protein, 575 aa, Actinoplanes utahensis
MKRRGAGNGGRSWTHSLGDLVRQSGQRPGGRATRADLARAAVLIRTASRLARVDTPDDVLQMLATDAVHAFGARSISAVITAPGGPGFLAVAGDGVRLTRNDRIARLDPESPVAAVMRDRSPGRPVPAGPLVLPILVDDRTLGAIEIDTDDPELDFLSALIAQFAQAWDRTVARADADRAHVQLQALNDLSGRLGSAAEPAQVFRALLDTVVPRLARGVLIHYPGSDKVPSLIAGTHADRLRWQSLEAAVNGDPAHPQTTATIGEVLRSGASAITTVDTESWLVSPMQDGVDRLGVLTLVRDAAQPFTDRDIPFASEWSHRAAVALARIRDAQRLRRVADELQSGLLPRRLPAVAGLSLAGRYRPGRRDLQVGGDFYDVFRTGGDRLSVVIGDVCGTGPVAASRTALVRHSTRAFARVLTGPDQICAAASEALLQQEELNGAFCSMAYASLRTGGDRITVDLVLAGHPRPLLRHADGRVCEIGTSGTVLGVVRDVAYTVTRHHLTPGETLLFYTDGASERRHGDRFLAADGLRDLLAEAPAGSAEELLDHLMERILGFSDQPLADDLALVAVHSE

SEQ ID NO: 15272 - protein, 217 aa, Actinoplanes utahensis
MRLTRLGKKAAAVATTAVVASTLTAAPAFAHGTAQPLKTRSLAAVLTADKSGFDRNGRDYDILTAAVQAVLKAKPASPVGVLADGNTALTAFLPDDHAFELLVADIQHSKRLPSEKAAFTAVAGLGIDTVESVLLYHVVPGATIDRKAALKADGAKLKTAAGATVTVDVYGFCVKRIALIDADTSDRNPRVNRFDINKGNKQIAHGIDRVLRPIDLP

SEQ ID NO: 15273 - protein, 356 aa, Actinoplanes utahensis
MESRRHSHRSSPGDSTGAAEPAFGNTEYERPVDPDVELRHLRVFDAVARTGTVTDAAVSLGMAPSSVSEQIRALENSLTVSLFERRATGMRLTGDGQRLVGWARQLLDLADRATADMTGQRSDVRLGALETLVATCVPAVLARLAERRPHLRVGIQSSADRLALLTDVDAGRLDAALLLDTGSTLGELGFRPPAASLRFLDLAPVPLTLVTEPHHELQRRPSHPTSLHGQRLLLNAPNCSFALAADKLLGPGPERTFVGSLPTARSWAEQGLGVALLPEFAIADAVRNGTLAVLDFPLPALTLRLVWRADRENTPHVRDLLYAASAYAPERAPGLTRRTAPSSSHQEAIGDGRITR

SEQ ID NO: 15274 - protein, 468 aa, Actinoplanes utahensis
MAVRRGIALSGVSLGYFMVLLDMTVLAVAEPDVARALHASVAGLQWTTTGYTVVFGALLLSAGAVADRYGAHRVFRAGVAAFGLLSLLCAAAPTVSALVALRVLQGAAAAACVPASLALIARLYPDPARRTRAIGTWAAISGAAVAVGPVVGGLLVDAFGWRAVFVVNAPITVLVLVLASGAFLRCPATDRPVQAAAQVVLGVAMAAGTDAVIAAGRASWLHAGGAAAVAMLAVAVFARRERTGSTPVLPRELLAGPGIPAGLFVGAAVNFTLNGTLFVLPLLLVQDRHLDAAGTGLRLLPLTLPFVVNPPLTGRLVSRFGPRPPVLTGLGLLAAGSAGLAWVAWSTAGDGWLAAALLVVGVGVSLVLPAVVAVVLSAAPPAAAGAGSGLLNAARQLGATAGVAMMGALLHTGVRTGAGGALFLAAVVCAVAAAWFGFGGRRRGGPENRTRFDQGRLPRTPWRSSPGR

SEQ ID NO: 15275 - protein, 373 aa, Actinoplanes utahensis
MGFSEMPRESEPLSPWRPWTFDADHSSEFDLPVIREPDRPFDHESDLSFEAEPGTHDGVLADGGEHESDLADGPGFPDGHLADHVWMTKEVTISILADAVQAPEVRRATLTTVTDRATISDSFCVVIGDHGQLEYRARREIGTVEFAPDRLREDLGFIARWALDRLVENPGNLLLNGIFQAAVWGAIETPCTRTVFGTGTDGPMQIAVFDCARVMVGDHAKAVVADHRSQEVAEVDFARLIPGHPGLVRALAEVLADPLDQGLRDGLDRAARAAADDFAPGDLLDAAATDGGARRGRIDFPGLFGGEVTVDGVIGAVIGTDITTSRSVEVRIDAIAITGDWGGEIEPAAADERRRWNELEWFLLQEYLRKRRP

SEQ ID NO: 15276 - protein, 60 aa, Actinoplanes utahensis
MLVLAAVAGILIGLLGGLLVGHNRGRWCPRCGRTLDCHACQRFPAPRPREPRNAGPDAFR

SEQ ID NO: 15277 - protein, 296 aa, Actinoplanes utahensis
MTASETTGSTIPRRTLGLALRKAREDAGITMAAAADVIGQSVQSLRRIEQGTVSTPKGKVTLLCMHYGIPNQTRLVYEQLALETRSKGWWQSFGDAVPAWFELYVVLEQTADRIRSFDPLLVSGLLQESGYMDAAILAVEPDLKADEVAARAEVRRSRQRQLTRSFPQPPQLDVILTEPVLMVDLPEGVMRAQLWHLLKATELPHVSVRVIPLAAGLHRASVTGPFTLLDFPIEGGNRPPSTVYSESQTGAIYLDRPHEIEAYERVWNGIDAAALDQARSVKLMSQRLKELNDRES

SEQ ID NO: 15278 - protein, 71 aa, Actinoplanes utahensis
MSLDLSGAEWRKSARSGGSGQCVEVALELPSAPGFVAVRHSQRPSAEVIVYTDTEWAAFLGGVRDGEFDKK

SEQ ID NO: 15279 - protein, 71 aa, Actinoplanes utahensis
MTIDLTVANWQKSTRSGGSGECVEVALNLPNAPGFVAVRHSHRPDAEVITYTDAEWVAFLGGVRDGEFDKP

SEQ ID NO: 15280 - protein, 71 aa, Actinoplanes utahensis
MPDQARRERWPGAVRGNGYRGVVPGARLADQRSSTRPNFQMAIASSPVRAQTGQSMDDLIKELTLLMADPP

SEQ ID NO: 15281 - protein, 481 aa, Actinoplanes utahensis
MAVTPDLAVPETDPTPVKSGRRPSAFGALLVRLHFYAGLLVAPLLLVAAITGMLYAFIPQLEHLAYRAELVVTDPGGPALPLAEQVASARAAHPAGDLLTVRPGEGSATTQVDFSDAALDADHQHTVYVNPYTGRVTGQLTTWWAATPLTEWLDNLHANLHLGETGALYSELAASWLWVLALGGVLLWWRRQRDRKRRMFVPDLTARKGVRRTRGWHAATGLWITVGLLFLSATGLTWSNHAGANFTALIDAMNSSRPAVTTDLTGTAAASGGHHAAMAMGGADGGTVDPAAITGVYGAATAAGLSGPLSITVPADPKTAWSVTEIDSRWPVGRDSVAVDSTGRIVQRIDFADWPLLAKLTQWGIYAHMGQLFGLPNQLLLAALALGLICVIIWGYRMWWQRRPTRAARRAPVGTAPAGGNWTGLPAWTIVIGLPLLFAVGWFLPLFGIPLLAFLALDTIAGLIRPRRGPAVPVSPAPAGR

SEQ ID NO: 15282 - protein, 218 aa, Actinoplanes utahensis
MTVTHHRFDGMLGAWLRAWTRSRGTPVPETVPGGWRVDVGLPGHRQRYLLHTYDRRSLSDLARRESAPGTWIKTAGGEADLHAAVPPGWERADTYQFMTITFGARPLTLPSTYTMAIDRTGPLSTVTIIGEQGDVAASGRLVADGAFGMVDRIETAAGHRRRGLGTAVMNTLARAALDGGARTGVLIATDDGRQLYESLGWSARVPIAAAFVPEVTDS

SEQ ID NO: 15283 - protein, 141 aa, Actinoplanes utahensis
MRGNPFSEAVWALFRGVIGLLFALHGVSTVFGVFGGNRGSGHAAAVGSWPGWYAGVIQLVCGLLVLVGLLTVPAAILASGSMAYAYFTVHQPHGLLPLENGGDAPALFCWAFLAIAVVGAGRWSLDALRRSRTPSLETVDA

SEQ ID NO: 15284 - protein, 252 aa, Actinoplanes utahensis
MNLARPSSLNDAAPGKAVGVTRAAAYFLVMRPQLTTLTVEAPDPAGPGRFWAALLGREMIVDAAGVRLPGDDTQVGLRFVAGRAGRLGTNRIHLHLTSDDPDDQQRIVAAALDLGGRHLDVGQRPEEGHIVLADPAGYEFCVIEPGNDFLAGCGPLGELACDGTREVGLFWSRALGWPLVWDQDGETAIQSPHGGTKIAWGGPPLRPKTEPSRQLFELVTDSVDELLSLGATRLGPGLLADPDGNEFRIRPA

SEQ ID NO: 15285 - protein, 332 aa, Actinoplanes utahensis
MRIPRPFWAVSAALVLIGAGIVHNASPASAFPATPKSTVINYLKSITGTSIVSGQHNKEPASQPAQYTAQVKAITGQYPGLWGGDMMFTSTDIANRQAVINQARTEWANGSLVALTWHACSPTVGASCNFDGGVKTSISDAQFQQIVTPGTTLYNTWRSRMAAVVPYLKQLKDAGVPVLWRPFHEMNESWNWWGHRSGSNGSLKLYQQMRDYFTSQGLDNLIWVWNVQDNPAGGWGDFYPGSNYVDVVTLDAWYKSYPSSADYSQIQSIAAGKPIAIAEMGKVPTSSLLTSQPKWTYFMIWSEQLRGSNTNAEIQTAYFLPRVLNQGEIRLS

SEQ ID NO: 15286 - protein, 321 aa, Actinoplanes utahensis
MKRSFAYVVAALSLSGMLGSPAAASSGHSACRRAAGAGEQTVGVTFAGTEYPVTVYVPVGVRPGTRLPAILNLHGTQSNGSNQLHYSDMAAAADAGRFLVVAPSGNIPAAGGFAWNVPGVGTPPAGARDDVGFLSEVIATAVRSLCADPARVYGTGYSGGGRMISAFACHRADRIAAIAPVAGLRAGRPDPLDKTRPDPASCQPVQPVPVLTFHGQQDHTNPYQGGGSEYWSYPVPVAQQRWAQLDGCRGAARTVAVSTHVTRTSYRKCRSGSEVTLYTVADGGHTWPGTPIDNGNGMVTQEINANTLMWQFFRRHRLRSF

SEQ ID NO: 15287 - protein, 352 aa, Actinoplanes utahensis
MRHVRRHWRLRRAAPPRTAVTDAELTADPGADFVDLTITALHLSGQRREVAEATRWREPDDRELLSLWWLEAAGQLTGPELAAALSLTPAQAAVRVQRMKAQLERARSVVRAVSAVPLCPLLSGATRDWGGRPAGLWGKRIARHLRECATCDRALADVIPAERLLAGLPLLLPPRVFPPLRGPRHTARRWLPGVSGAAVVLVGAVAGVVLTRSPERTPVPQARTAPAATAAATTTAATTTAPASRPHRCRRRHRAGLRRSSRRNQRPVSRPGRVLLSLVRRELHRGRHTLPLVGRPAFGRRPSHRHPPDRRHEVRGAASRHHLVVGGLMLVTGQPTTRSEPRRTGGSTISGR

SEQ ID NO: 15288 - protein, 596 aa, Actinoplanes utahensis
MPRPRPDAVIAPLDTSFDGSRPLRTTWRLLAPSRWRVLAALLAFGIKDSPVWLLPLLTAGIIDVVVEHRPMGQLWFNAAVLAVVLLQNLPVTMLWVRLMSRIVRSLGTRLRSMLASRLQHLSIGYHTRTGTSLAQTKVVRDVENVELMLQQVTQTGASALFILLGALTLTALRVPQFVGVFLLVVPVAAGLVAVVRRLSGARNEQFRRRMEQLNARVGEMSTLMPITRAHGLEQVALHRVRGTVEEVGAAGFRLDLINGRLGALSWVSYQLLGAACLVGAGWAAYTGMLPVSAGDVVLLSSYFALLTSAVVMLFGLAPIITRGLESLRSIGEVLQAPDIEHNEGKRVVTQVTGAIELRDVRYGFDPQPHVAPAVDGIDLRITPGETIALVGASGAGKSTVLNLLLGFLRPTSGSILLDGVEMEEIDLRTYRRFLSVVPQESVLFDGTVRENVTYGRADVPAATVRAALRDANALDFVEQLPAGWDTVVGERGARLSGGQRQRLAIARALVRDPRVLLLDEATSALDGESEQQVQQALARLMHGRTTVVVAHRLSTIRTADRVAVLDAGRIVELGTHIELLARGGAYARLYAAQSPP

SEQ ID NO: 15289 - protein, 45 aa, Actinoplanes utahensis
MRKALLTPVIAGNIQTTAPGDEAVTAAAIRTGKYLAECRDHGPTQ

SEQ ID NO: 15290 - protein, 826 aa, Actinoplanes utahensis
MRLLRAATIVLTLVTSVFTVPSAAYATPPRQGFVTRAGAELRLNGKPFRFAGTNAYWLGLDENVGGIDYPTYFRIRDAIDTAKGMGMTVIRSHMLVSSGHPKTLLPSKETGYNDDAFKTIDYAIAYAGQAGIRLILPLTDNWAYYHGGHADFTKPYGLPDAAFYTDPRVIADYQAYVWHVMQHVNPLTGKRYIDDPTIMAWELGNELEGMTPEWIGANAATFAGWAPRQLIAAGRRFDIDPDTLGAAAVDIVDVHYYPPTAAKVQADAATVAAAGKVYIAGEYASTAAGSALLDPLVTDRNVTGMLSWSLFGHHDRSGFVQHDDGFTFHYPGDDARMTAANQAQIAYAKALGASIPKQPAGTPLITAIDKRGGLNVLQWRGAAGAAGYRVERAPTERGPWQPAYNGLLTDDDTPWTDLTAPGNAWYRVVAGNRRSQPQYVGATDTVLVDPLESFGLTSGHTGVEIHPGTDHATVRPTGNGPAWVSWQHAGTRKVRFDIAADRHHDLAIQVSDDGVIWRTVGSHADRDSVTAATAGSAHVRVLWTGRGRAGITGATFWAADPAPITGRPAAFGVTAPAAGATDVIGPEAFAWEPSAGAGYYTLTVSRHPDLSDPVLTATGLATTTHTPAHGLDPATTWYWSVRATNAAGSSSTPVASFATRALPSAPATIDDFEGYADSAALAAAYPRNTGGDVVTPTLIPASSGSGHAMQLDVTAGSSGYAGVSHTFTTPVDLWGQQGIELVLNRSATQASITLQFVANGVYWEHTLPAGTPSGVVRVPFTSFAQPPWAPSGALDLRKFTQLSIYLGGSDSGRLTVDNVSAYPAGQ

SEQ ID NO: 15291 - protein, 797 aa, Actinoplanes utahensis
MTSVQDLAGSWELHGDGVDLPATVPGCVHTDLLAAGRIPDPFQDDNEHAVAWVGRADWTYRREVAWTGPAHERIDLVFEGLDTVATVELGGTTLGSSRNMHRSFRYDVTDLLDGDPRPLAVRFESAYTEAERVRELLGARDNAYPEPFNFIRKMACSFGWDWGPTLVTAGIWRPVRLEGWSTARLAEVRPLATYADGLGRLDLTVGVERTRDRDLHARVLLDGYEIAVLEIRDGETVAQAIVDAGAVTPWNPRGHGEPALYELSVELLDGDTVLDRWQRRTGFRTVAIDQTGGGFVFHLNGAPILVKGVNWIPDDIFPSRMTRARYELRLREAADAGVNLIRVWGGGLYESRDFYEVCDELGLMVWQDFLFACADYPEEEPLFSEVVAEARENVARLAPHPSLITWNGNNENLWLHLAMPWNADGKYETWGSRYYLETLPEIVAELDPTRPYQAGSPWSGSWDHAPNDTEHGTFHSWEVWNREDYLNYRNSTPRFVAEFGWQAPPAWTTLRDAVSDEPMLPDSPGVLHHQKAEDGNGKLARGLAPHFGDPASLSVEAWHYLTQLNQVRAIRTGVEHWQSHWPHTGGSILWQLNDLWPVTSWAAIDGAGRHKPLYHALHELYAPRALTIQPRDRALVVAVLNDHPAAWTGTVLIERQDTGGAVLASTVQHVSVAARSVTLIPVPADLVGEVLVARLDDARALWFPTEYSSDDPALTIDVESVPGGLDVHVRAVGLARDLLLQPDRIHPQATVDRGFVTLLAGESTVFHVRAPIELDPTLVKTPWVLTDLSSVLNRGKN

SEQ ID NO: 15292 - protein, 301 aa, Actinoplanes utahensis
MTTATRTPRHASPRPPAPVKRGGGRDLAVARTATTAKYVSLVLASLVVLIPLVVVLFASLKTHVEYNSTGPLTPPHNWLNFHNFATAWTAGDMLRGFWNTTFILVVSLTGTVAIGTLAAYAISRFVFPFKRLVLGLFLVAALVPGVTTQVATYQIVKSMGLVNTSWSAIVLFMGTDIVSIYIFIQFMQSIPQSLDQAAMIDGAGRFTIYRKVILPLMKPAIATVVIIKGIAIYNEFYIPFLYLRSPNLSVISTALFRFKGPYGAQWETIAACTMIVIVPTVVIFLLLQRFIYNGITAGATK

SEQ ID NO: 15293 - protein, 311 aa, Actinoplanes utahensis
MTSQVIPGARPATTAGRAAGKPRRRRFWQTPYVYVAPALILLIVFTYVPVGNMIWYSFHKWDGLDVTMDPVGLDNYVRVFTDEQYWHVFLISLYYFVASFAQIAIALYFAVVLSFKVRFKNLFKGILFFPYLLNGVAVGFVFLYLFQPDGTLDTLLGAVGLGGHTQLWLGDPDIANISLAGTSVWRFTGLNFVLFLGAIQSIPGEIYEAAEIDGANRWHQFRHIIVPGIRRIISLSFILAISGSLSVFEIPFIMTGGANGTRTFVVQAYQTAFQFRQIGLASAMAVVLLLIVLLITWVQRRVLPDEEVTLS

SEQ ID NO: 15294 - protein, 437 aa, Actinoplanes utahensis
MINRRTFLGLGTVAALALTAGCTGGASDDTGTSGDFSGDIKGNITVLTNRTDLVSTTLPEYAKKFEAKYPGTKVTFQGVTNYDDDVTTQLSSGDYGDVLMIPGTAAVDQYSQFFEPLGTQDELKAKYRFLGPATYNGQVYGLSVGGIAKGFVINKRIWAQAGITTPPKTPEEFVDGLKAIAAKTGAIPYYTNYKDGWPLGEWNSYRAVLGDPEINEKFPADASPWQPGKIQYITDSLLYDIVHNKLSEKDPLTTNWESSKPMLASGKVATMLLGSWAVPQIQEAAKSAKADPADIGFWPFPYQTGGKFHTAIDGDKLAAVSKNSKNKATAKAWLDFFVNESGFAADQQAIPPAVSQPLPKGLQEFTATGVELIEVPAATTNAGKEDEIIRTSEIDLKGPIYRQKLVDIARGAAKGDKESYFADLNKRWSAAQSQVMK

SEQ ID NO: 15295 - protein, 71 aa, Actinoplanes utahensis
MARREAPAAGPGSRALIVDVIRSAVTISRGELVDLTGLTQPSISNIVRELITDGIIHEIGSLDSAHGRLAS

SEQ ID NO: 15296 - protein, 283 aa, Actinoplanes utahensis
MVGREVVPLLPDEPWHADRLADRFEHFTAGLDLPRDRIEGLAVVAPGAWPPEVRPGLVDRIGVPVLVENDAAAAALGEFWSRRVSRDQVFGCVYLGNEISAGLVFGGALFRGASFGAGAFGHMSIHHEGRPCPCGNQGCLQQYASTRAIVEAARELPELRARLPLDGTESAAYEAIARAAVNGDTDAYAVLDQAAGWLSTAATSVVNLLDLGRIVLTGPGVALAGSIFARRLRTHLDRTAHSRHQHSVTVEISAQPRDAAGIGAAVLVIQASVAPGHTPGRSS

SEQ ID NO: 15297 - protein, 289 aa, Actinoplanes utahensis
MRNIPKMEEPVTPRPRRVGLVLARASQVLGEEPYYHEFIEGLERLLIPAGISVLVKVVTDHAAEKATYEQWSAEQRVGGVIMVDLSPGDDRVELVRKLRLPAVVIGDPSTADGLPTVWTDDAGSAREAIRFLADRGHTVVGHVSGPRSLAHTQLRLGGFQAEAAARGVTLIGAEGDYSQESGRVTTARLLAAHPVPPTAIVYDNDVMALSGLETMIKRGLRVPGDLSVVAWDDSAQCQLARPALSAMSHDVGRIGEIAATAVLDAMRQNSADNVYEAPQAHIVERDSTG

SEQ ID NO: 15298 - protein, 399 aa, Actinoplanes utahensis
MSTTPPADTVQRLLDFGRAFPHPLGGAAWLRTDGTPDLDAPVHTWITARMAHVYSLGDLLGVPGAGPLTDAALAGLTGVLADREHGGWHPSVSPDGLPAAGKSCYDHAFVVLAASTATIARRPGAPALLTRALDTLVRHFWDPVHQMFADAWDTGWQRLDDYRGLNANMHAVEAMLAAYDATGRTDCLDRALAISERAVSRGREHGWRLPEHFDARWNARLDYHRDRPDDPFQPYGATVGHALEWSRLILHLEAALGPASPDWLLPAARALFARAVEDGWAVDGAPGFVYTTDWDGTPVVRQRMHWVAAEAIAAAAALHTRTGEEDFARWFSIWSDYVRGNFVDVQQGSWWHELDTDNQPAATTWSGKPDLYHAVQAMLLPRAPLSPGLAAACANGAVR

SEQ ID NO: 15299 - protein, 308 aa, Actinoplanes utahensis
MRRFLVVGESILDVISDEQRELPGGSPANVAVGLGRLGNDVGLWTHLGADPAGDLLRAHLTGSGVDLLAPIAGVTSRALAAIQPDGSARYDFAVEWPRWPGGPAPAETARHLHTGSIAALMAPGGGDVERLLVDRRDAMTVSYDPNIRPALIGDPDDCRTRVESIVAGSDVVKASDEDLAWLYPGMPALNAARHLLALGPALVCVTLGAQGALAIAGEVQVTVPPVAVSVVDTVGAGDAFMSGLLDGLGERGLLGAAARPRLHAITGEDLRAVLSHAALVAGLTVARAGATPPTRAELMVRNERASAT

SEQ ID NO: 15300 - protein, 462 aa, Actinoplanes utahensis
MKRRPVLVTLSVLLAGGAAVAVTLPASAAATGALTGLAGKCVDVAAGGTANGTKVQLWTCNNSAQQRVSVADDRTIRVLGKCLDVTGGVNADGTKVQLWDCFGNANQQWVYNSATKDIVNPATGRCLDAAGQSSADGTPLQIWTCNSQTNQDWVLPGGGGPVTPSPSASGAACNRTVQPGERTMPVSFAGKQYQVAVYVPAGAQPGTRLPLVMNLHGSGGTGSGQLQYSNMKPTADANQFLIVAPSGAIPNASGFAWNVPGVGTAPAGARDDIGFLEQVLTTATSTLCAAPTRVYGAGYSGGGRMTSAFACARPDRLAAIAPVGGLRAGRPNPQNTAQPDPASCNPARPVPVIAFHGQQDTTNPYPGGGSEYWQYSVPVAQARWAAINRCTTGPTTAPVTTHVTRTNYLGCANGADVVLYSISDGGHTWPGTPVSNGNGNTTQEINANTLMWQFFQRFQLPA

SEQ ID NO: 15301 - protein, 738 aa, Actinoplanes utahensis
MPADRVRGRIVRAGTRVVAVFAVLALAFGLADFRLVRAVFTDSTATGTNTFSAAASFPDYPTTISNDGAYFYHRLAEAQTSSATSNAADSSSNGTRTGTYDGRTDGPATWYDFEDIAGSAVADESGNGNSATLSGTTTVAGHPGSSVSFDGTASHADAARAGISVTTDFTVSAWVYLPTGADNQDRAVVSLSGSATSAFLLKFDDSDDKWEFEMAQSNIGAPTPDAAKSSGAPALDTWTHLAGVYSDASNLLTLYVNGVASATTAAHADANEWTPSGTLQLGRTWYNTAWATAYWLGRIDDVRVYQSAVTSTDILGMSTEAPTVHYRFDETGGTSVADSSGNANDGSTSGTATWNPGGWWGGALTLDGSGAAALSNSRAVATDQAFTVSAWVYLPSTAATITRAILSENGGNAAAFELKYNQAAPDRWELAMWDNDNSASNAAGAKSAAVATKDAWQMITGVYDDAADLLRLYVNGVQSGTTARTDAVEWAITNRLQIGRSRNYGAWANPFSGSIDDVRTYQAALTPNQISQLYKYGRTIPTGMTAGGSGALQGPLGGQAGNTAVAFNGSGSGFNPISFTNPTTFTIECWFKGSDNRGGQILAFNADQTSFFPTYTTDRMVYIDSAQRLVFGVNKAGTIVTAAYAGSAATWKNWHHVAATMSPANGIRLYLDGALVASDATGTAGGNYTGFWRWGGGHLTGWPNRPGHDYFVGMIDEVAYYQTELTALQVSRDFNANR

SEQ ID NO: 15302 - protein, 230 aa, Actinoplanes utahensis
MIWLSMGLHQKSVRRARRRRWPLRFWLIGILVAVLATVRSTNAVFTSRSSSTGNRLGAGTVAITDNDGGSALFSTASLLPGDSATVCTGVSYTGSVTSAPIRLFVDKTAAQESDSGAVYGAWADSTASMMDDNLTMRIEVSSNDLAASPGSNCNPAGVGSFTDVAGTFGTNMRTLIATNYDFATGLVSQWGTVVPNTWRVWRFTYTFSLAATAAAQSDGLKCAFTWAAQK

SEQ ID NO: 15303 - protein, 232 aa, Actinoplanes utahensis
MGRQSNQATFASVERHRRHRGIAVAVGVIACAAVVWQSSHATFSATTSSSGNRIGAGTVTIDVNNGGAAMFSTVGGDTALAPGASRSVCIGVGYTGTLAPTSVALYFPNGATQAKEMDAGSGTWNAWQSAVAGGAEMDDNVTLQVEVNNADLATDPGSVCTGTFGDVIAAGTNLRTLISTKSAWGATTSYTVPTMGNGKYRSYRFTYTLGAGAGNNVQGDGVEFTAMWEAQR

SEQ ID NO: 15304 - protein, 201 aa, Actinoplanes utahensis
MRVSLKRPWSAALPSDRAGARERRRLRAVNLLSDVRDAVVACLFGMLLISVAPALLGWKPTVVVSGSMLPTIRPGDVVVAAPVPDDPRSRVKPGRVVLVDDPALPDELLMHRLMRYDTDGRMILKGDANASPDSTPVTLESLRGVPRLRVPFIGLPFLWVQQGRFVPVVAAGFLLLFLVVWQPRRPQMTRDTVPDQTSAEE

SEQ ID NO: 15305 - protein, 217 aa, Actinoplanes utahensis
MNWTRRLRAPGVTAPLAVRPETSPVADVRPRAKLPAALVAGMVVSAGLVWQASHASLEDTVTNQGDSWQSGIVALTDDDNGAALFTSFGTDLAPGTGSTKCIAVTYAGDVAADVRLYLARLDDHGEELDTLLTMRIDIGSGSSCASPGNWTQLSDTDLRATANSAGTWAAGLTPGAWSPSGDQPETRPYRFIPTLADDNAAQGDQVELDFVWEAHST

SEQ ID NO: 15306 - protein, 376 aa, Actinoplanes utahensis
MTRPDRPPHPSLLRRGIGAVLVAVIAVATALLLQHKHTRTPAPQADRVLASMPLTGAALTAGSNAPLFDVRRMAPGHRVERCIVIAAASGGSVVRFGASGVSGALAPWLRVEGTIGTGTSRDCSDFAADATSFYTGSIAALGSAGTEGVPTGWVPGHAESRTFRIAVEVADDARAAGSSALATLTWRSQAPGVTPTTGPGTSAPSLPGTSSAAPTTTPPTTTPPTTTPPTTTPPTTTPPTTTPPTTTPPTTTPPTTTPPTTTPPTTTPPSITAPAAARPSDSAVPPAGGGLPSGTVPGDSMAAAPCPPTTAARVGDLLAGVARFSWLALLLLLLVLLFLLVQDRLDRGDPKLAHAPLYGEPHQAFPDNGSIPWRTQ

SEQ ID NO: 15307 - protein, 530 aa, Actinoplanes utahensis
MTLQPHPSRFGLLPLADRIRWSTSLRLGLAAMVAAFWIFLPGQRRTDGKDLFAVALLCAWATVLTVAAPRVGRRMAIVAVNIALLVDGLGLATALHAYGGVSGPISVLMVLHVCGVSLLTSFRSGGKVAVWHALLVLCVLQAEQVGLLTVKQPAPLPMAGYVTFVALLGAAALATSLYAALNERELRRRRYDAEVLRSLAVHLEASNDLGEIAAALTRLAVEDLLAVRALVVIEPASDEEGRGLRFVEKGWPPLPAALDTGKTAHAHGSLLADTEAGPVLVRNLDKQRDSYVVSRLPGAERLAVLPIPLGPAGRGHLVLDMGRSKRVEHRMMSTLIQATAHVGLALTRAGLVERLRLAAETDGLTGVANRKFFDAALAQHIDHAMRTGEPLAVTLVDLDFFKKVNDTYGHQTGDEVLKAAAAALRSTAREGDVVARYGGEEFAVILPGVPVDDVWQTAERFRNAVRTCPAPVPVTCSMGIASLPPGGVPPTVLLEAADQALYRAKEAGRNRVEIGHFTDESLGTAVGRGH

SEQ ID NO: 15308 - protein, 187 aa, Actinoplanes utahensis
MGAAPPLRRRRRTTCLWAAGLLTAAGMVVQSSRATLTSTTSSGGNSLSAGTVALSDDDSAGAMFSATGIKPGDNGQRCITVTYNGTVASLVKVYAATSISTLHPYLDMVIEQGNGGSFANCGGFTGSAIYTGTLSALGTSFAGGAGTWAPALSGSTQVYRISWTLLDNYAAQSKAAILAFTWEAQST

SEQ ID NO: 15309 - protein, 769 aa, Actinoplanes utahensis
MNRVVRLYSRRPVPACVQKRPMRMKWAFRARVSLTRRPACRMLATMTALVLLLAVPAFTCRRVRAVFSATTANSSSFTAAANFDAGQIWANGRALGSLVPAQVGTATWAQLTDGTFHNCGIQTDGTLWCWGSNTRGQLGQGDTTYRYDPTKVGSATWTQISAGYEHTCGIQTGGTLWCWGSSLWGQLGQGNQTNLSTPAQVGSATWSQVSTGGYHTCGIQTDASLWCWGYNERGQTGNPATLTDRDVSPFNVTSVAGPWRAVTTGSGHTCAVKTDNTLYCFGDGGDGRLGNNSTANSVALQQVPGTTWLTPYAGRNHTCATKTDNTLSCWGRGTSGQLGDGTWNTSLTPVTVAGAATWKSAGGRTVSTCGLKSDDTIWCWGDNFAGQLGAGDQNARNSPTSSGALTWASLASGFGSQGTCAIRKTLNTLWCWGFTHHQSSTPVAYPGTTYTAVAAGNDFACSVRTDGTLWCWGPNDVGQAGWNLPYGYPKQVTAATTWRTVTAGDRHACGTQTDNTLWCWGYASSGQTGQNNTATQTVPVQVSQAPATSWSAILSAGDNHTCAIKTDNTLWCWGNNSAGQLGMAAGDTTNRLVPVKIGSATWSAVAAGAQQTCGIQTDGSLWCWGSGANGRLGQGDTTGYQAPKQVGTLTTWSRVTAGGGHVCAIQTDGTLWCWGLNSSGQLGVAVGDTTDRPSVTRVGTATSWKSISAGQGHTCGTQTLRTVWCWGQNGYGQLGLGDTINRTVPTQLAGIKRRPITSGSAANTTYAIE

SEQ ID NO: 15310 - protein, 463 aa, Actinoplanes utahensis
MLRLPGTASAFSVTSKATVISYLQSITGKNIISGQHNKEPASSPTQYTQQARAASGQFPGLWGGDMMFNPADVANRQTVINEAKTQWAAGSIVALTWHACSPTVAATCAFDGGVKTSITNAQFTEIVTPGTTLYNTWRSRMAAVVPFLKQLKDAGIPVLWRPFHEMNETWNWWGGRPGANGGAKIYQQMHEYFDSQGLDNLIYVWNVQDNPTANWAQYYPGSNYADVVSLDAWYKNYPSAADYAQIQSIAGTKPIAIAEMGKVPTAAFLTSQPKWAYFMIWSEQLLGSNTTAEIQSAYANARVLNRGQITIGSGGGTAAPATTAPNTAPAAAGATGKIRGVPSKKCVDVTAAGTANGTAVQLYTCDTGGSAQAWTRAADGTVRALGKCLDITGGVNADGTRLQIWDCTANNPNQQWRYNATAQTLVNPATGKCADAVAEAIANGTRLQIWTCNGKANQRWAMS

SEQ ID NO: 15311 - protein, 502 aa, Actinoplanes utahensis
MIATSLAMMRHRWSRSGLLPKVRGLFLINLLVSVVTTVQQLAFVSTTNGLIRTASGMSMLWLGASAVYGWRRQRLSAVTEPLEWLVVLFAGIAIGRVNPALASFYAVLVFRPLYGTRSSAVTRPLMAVAVLAMLPVVVAATGGVSELDTLVQIPGVVIIATVTFLLGNALAGQQRAEARQQALIRTGTALNALDKRESVHAEAVAAGLALLGDSPGYCAIVVCHDGTPRVAAFQGTTRESLPGTSVLSSDDTLRAAFADQPDSATDQRVGSVNDELLLPLHGKRGISGLLVVGAARGVRKEARADLSTLVNQVVSSLDAAQLTAELVQRASYDALTGLANRALLHSRLDAAVAATGPDRPQAAVLLIDMDGFKQVNDTLGHHVGDGLLIGVGDRLRRVVRDVDTAGRLGGDEFAVVLAGVTGAEEAVAVAERLLHTLDEPFEVAGHLVVARMSIGIALAGGSRQVDGADLLRDADAAMYTAKRRQTSSWQLADERSPHAALT

SEQ ID NO: 15312 - protein, 392 aa, Actinoplanes utahensis
MARRETSVAGPGSRALIVDVVRSAVSISRVELAERTGLTQPSISNIVRDLIGDGVIHETGSADSARGKPRRLLAITAASRFGIGFQLGPDTLTCVAIDLTGGVVGREVVPFDGADLPEQLTERFDDFMADLDLARDRIEGLAIVTPAVRPGDEATVPPWTEVRAVLAERLGIPVLVENDAAAAALGEFWSRRVSREQAFGSVYLSSGIGAGLVFGGALHRGASFDAGELGHMSIAYDGLPCPCGNRGCVERYASMVATVDAARAAGLALEQQSVFGAYDAIARAAVSGDPDAFAVVDQAAGYLSVAVTSMVNLLDLGRVVLTGPGMAIAGSIYARRLRETLARTAHARHRHEVVVELSAQPRDAAGIGAAALVVQASIAPGHTAGLPATNDA

SEQ ID NO: 15313 - protein, 373 aa, Actinoplanes utahensis
MTRWAYRALDGAVIVAYPLLMVVAVRSVQVNDDGLRVLWPAVVTLLPAVLVGRRPVTALLLILVGTVFGFTVIGAGDSAFGLRLITAFGVGAVAAARRTRVGVAAAAVAWVALVGGEMSGWMIATGEPVMERVQDALSAALLTFDALLVAVGLTVGLLLRQRREHAGAIRARAAEQAITEERLRIARELHDSVAHRVGVIALQAGAANRVFETQPARARQAIGVVENSSREALAELRRMVGGLRSADGAMPGAGLAGLPDLVAATAEAGVQVEVLWLPTDLPADIDRSAFRIVQEAVTNVVRHAGVQACRVTIEQDAEMLTIEVTDEGRGGTGVPGHGLAGMRERVSLLHGEFEAGPRPEGGFRVFARLPVAA

SEQ ID NO: 15314 - protein, 216 aa, Actinoplanes utahensis
MTVRVLLVDDQPLIRAALQMVISEAPDLEVVGEAGNGGEAVRLAAELRPDLVVMDLRMPGMDGIEATRRIAGQTRVLVLTTFDDDENVHRALRAGASGFLVKDMALDDILDAVRVVAAGDALLAPGVTRRLLQEFARRPAVAAPRAPEGLTDREVEVLAEVGRGRSNPEIAADLHITVATVKTYVSRLLAKLGARDRIQLVIIAYDAGLVTARDAA

SEQ ID NO: 15315 - protein, 547 aa, Actinoplanes utahensis
MDVAILQRIRQGLIGAGVILDGPYGPRRTTHADYTASGQALDFIEDFIRFRVLPKYANTHTEASATGAQTGCLREEARALVHRSVGGGPDDVVLFCGSGATAAVNKLVGLLGLRIPENLDEVYGLSPLIPRAERPVVFVGPYEHHSNELPWRESIAEVVPIGADATGHVDLAQLRAALERHADRPLRIGSFSAASNVTGILTDVSAVSALLHEHGALAVWDYAAAGPYVPISMADKDAVFLSPHKFAGGPQTPGVLVVRRQLMTNRVPVVPGGGTVAFVDPTGHKYLDDPVAREEGGTPAIVESIRAGLVFKLKDEVGAEVIGAREHELWQRLLRRWAGVPGIEILGDLRADRLPIVSFQIRAGDRYLHHNFVVALLNDLFGIQVRGGCSCAGPYGHRLLGIDDAHSREFQTEIAAGWEGIKPGWARLNLGYFISDAVADYLMEAVALIATHGDRMLADYRFDPRTAKWSHVNAAQPRVHLSDLRLGDEIPGPAPTLGEEVLPSHLAQARSLMESRPAAVDGDGHGLPPSFEKLRWFLLPAACLAQH

SEQ ID NO: 15316 - protein, 229 aa, Actinoplanes utahensis
MDLLLLHGLGATGEVWSGWDPVLRDRWPGRWQAPDLPGHGAAAELDEYTFDALAEALLPLVDPAGQTVVLGHSLGGVVALALAARVPVAAVVGLGIKVEWTDEELARARGLAGRPVAWFDTREEALARHLRVSGLAGLVADDPGGIRADGGRWRPALDPRAFGVGAPDMAGLLSRSSGPVLLARGEHDPMSTGEQLAKLGVPVATLPGLGHNAHVENPAQCFSLLAAYH

SEQ ID NO: 15317 - protein, 251 aa, Actinoplanes utahensis
MPSPRDVAHLTTLADFCAVRDVGVLSREALGPVDVAILFGGSILAGGDLFARAITDRVADHFMIVGGEGHSSDVLRAAMRSHLGGDDVPALSEAGLFDRYLRRRYGVHADLLEHESTNCGSNVRNALALLAARGVPHRRILLVQDASMQRRMDAGFRRHAPGAQIVNFAAHRTTVDLIDGEFGFRSPPAGMWPVDRYVALLMGEIPRFAEYGPAGRGFIAHVDVPDEVTRAFAALREAGVAAPRVADQRWA

SEQ ID NO: 15318 - protein, 216 aa, Actinoplanes utahensis
MRDVARARHQPSVPLPHPPGAPAAPPRTSGVLRVGENDAMPTIETARLTLREWRDEDLDPLAAMNADPEVMRYILDGEVRDRDQSAAGLQKMIRDWRQQGFGLFAVQVRDTGALIGWAGLAVPTFLPEVLPAVEIGWRLSRAAWGHGFATEAATAALRFGFDTIGLDRLISIRHVENVRSARVMAKLGLLQEFETVIPGFDQPVAVHARSAVPRLG

SEQ ID NO: 15319 - protein, 139 aa, Actinoplanes utahensis
MLSPFPAQVGAGADDGLPRLLVGQPERWATIADTVNGVDRAGRGERVPTVAEGAAIASPVRLPEAVEALRRCGGAAVAVAEEQIHGAVRALATRGLYAEPTSAVAAAALDHFIADGTITPDQTTVVVLTGSGLKSADKR

SEQ ID NO: 15320 - protein, 241 aa, Actinoplanes utahensis
MARRLFLGSFTAGAVTVALGESTPAAAETTTTTFPGPVVAQRFSTDSTIESAYFKTTSVTDNAVTVYQAAASGRGVALNVVSDNPENSAMYLEGTETGRGTLKITHQGYDDGSDRSAAALSIDLRTAGTAAQGIYLTATNGPTTGSLIALRNNPGRDDFIVTGAGRIGIGVNRGDTPRGQVHIVQQPGVPAGVLIEGVVRIANTATVPTSADSSGGGNLYAVNGALMWRSANGKVTQIASA

SEQ ID NO: 15321 - protein, 64 aa, Actinoplanes utahensis
MQLTADELVSEFHDAVMELYFARKRIVALEAEILALRAQLDTGERECTADAAEASTTPQESASR

SEQ ID NO: 15322 - protein, 565 aa, Actinoplanes utahensis
MRMHPRAWLAVAVVAVVAGGWVAVSAGDDATLDDDTAVDVLTGHDWTHFAGATVGPGGVRIVGLGERIVRQDGSGGQPDPPVNLRGPRLAVRGPMEIIAGVDRPAGRAAVFSLYGDVPVVYDEWRHNPPGLAVTVTDGELRLAVWDGRGDDPAVRRRTTVTAPGAATITVTRAGGRLTVRLGDAGLSVTDPGVFSSGRVFFGADVDGGGPAGWTLTSLRAAGLDGGSVTVVDAPALGQPAPEPGSLRVLAAARRALPIGAAVAAEPLLADDGYRRLTAAQFSMLTTENAMKPQFVHPQPDRYDFTGGDLLVDFAAANGIAVHAHTLVFGEANPRWMQDTPADRRERIMLDHISTVVGHYRGRVAEWDVVNEPLSPDGEDYEDGGAGLRRHLWQQAMGETYIDKAFVAARSADPGAKLYLNDFGLEADGERWDALLSLVGRLKQRGVPVDGVGFEAHIHEAGDRVTAAVLQDHFADLARLGLSARVSEIDVYGDAAAGQAEQYATALTACLAAPNCTSYTTWGVSDRYGSTTESGTYPPQLGDDLIFDRNLAPKAAFTALTRVLRG

SEQ ID NO: 15323 - protein, 79 aa, Actinoplanes utahensis
MVAAAASNTAVRRNFDMSSPWSGTATRRDADRSHSKLGGSRPARRSVKPDKGYCRLDSVRDFWFGFPSMLLLFTVARGR

SEQ ID NO: 15324 - protein, 208 aa, Actinoplanes utahensis
MARRRRRRRSRISDGAALAAAAGGLLAVGLLAQVVREHLVLTAVVTAVVTALVLAGGGAWAYLSWSAMSRLAAHERDVAVTDHMSGPEFEQYVARLLRESDCRGVRVSGGAGDMGADITARTPDGRRLVVQCKRYAGNLPSPDVQRFAGTARDIHGADVALLVTTGRPTGPALQVARQCRITLVDRPVLARWIATGVAPAVLSDRGRR

SEQ ID NO: 15325 - protein, 265 aa, Actinoplanes utahensis
MRTRSYQRNLGNGTRRKVAGVVIVGGVLAAAGLAGVQLASASTTPPPPKAAANAQQAQGGNDATLASAQALETACDTFAADAAGANGQNAGNQGADNQNGDNAQNDQNAGDQGAAGGKAAGKDGAKAGAAAGKAASDARNKKIAKKWAKAMAEANKKRGKSGKKGGKYGQNGNANQNGNANQNGNANQNGNANQGAANAAVTSAQASLLQACLALADAKAVAGISNNNGNGNNGDQTADPSASATADPSASAGADPAESDSTAAN

SEQ ID NO: 15326 - protein, 112 aa, Actinoplanes utahensis
MLALANITFDCADATALAGFWAQALRRPVDPGANPFFATIGAAEPGPTLMFLKVPDDKAAKNRCHLDLNADDRELEVKRLAELGATVQSEHQEYGKHWVTLQDPSGNEFCVA

SEQ ID NO: 15327 - protein, 257 aa, Actinoplanes utahensis
MDDLLPIGAFSRATLISANTLRAYHENGLLEPAVVDQRTGYRGYRIAQLGDAATIRQLRELDLPLADIRVILAARDPEVTRRVLAAQRRRLLDRQARLERMLRITGDLLDDPVAITPAEVTARTLPPITAFTLTRDAREDQFADFLGEAYAELTARAIATGPCGAIFPPEFRDEPSPIIAYVPAANGDTTLPGGRFAVAEFVGPYYNMSEGYRALGAWLARTGLAITGPVRESYLVGPGDGVPEEEFRTEICWPVSR

SEQ ID NO: 15328 - protein, 260 aa, Actinoplanes utahensis
MTEKALPGGNITGAVLIDGVVHKPASPWTPTVHAFLRHLEAAGFDAAPRALGFDERGREMLSYLPGETIGGRVPWPAWVSSDAMLVQVGRWLRRVHDLTAGFVPPEGERWFVGGELRPGLVVGHQDASPLNAVVDGDRLAGFCDWDIASPSVPEWDVAFSALTWVPLAAPQDGTPLTEDDRRDRARRFHLLLDAYGYAEDRRAFATAVPQRARKQAAVIRHQAASGDPASTALLPIADLLDRSAADVDALPEGFWIKDRI

SEQ ID NO: 15329 - protein, 144 aa, Actinoplanes utahensis
MASVKQFQVTFDCADPERVARFWCEVLGYVPPAPPAGFASWDDYNASRPAEKRNAGFSCSDPNGVGPRLYFQRVPEGKVVKNRVHLCVRVGTGLVGDERLAALEAECARLEPLGAKRFRLLLADGENESCLVMQDIEGNEFCLD

SEQ ID NO: 15330 - protein, 150 aa, Actinoplanes utahensis
MTTVTESVDVNVPVSTAYNQWTQFEDFPKFMDGVESITQTDATHTHWVTKVGGQIREFDAEISEQHPDERVAWHSTGGDTKHAGVVTFHRLSDTETRVTIQLDWEPEGFVEKVGSAVGVDSHQVKADAKRFKQFIEERGTATGGWRGDVS

SEQ ID NO: 15331 - protein, 177 aa, Actinoplanes utahensis
MSGAPQTREALLDAGAALAERHGLSGVSVNMVVAEAGVAKGTFYVHFKDRSAFVDALHARFHARVEAGMAAAVAGLPRGAERLLRAFEVYLDISLQNRGAKALSLEVRSGPEQGAMTARRERLAEGGFADLEAMGWEDVEATAQLLVAMVREISALEFDAGRPLPASRRALRRLLDR

SEQ ID NO: 15332 - protein, 345 aa, Actinoplanes utahensis
MHVEGALGDARLRHHHVHADAAQPVPLRQRGAGIQQRLAGLRSSRHGQVLCHVESLDRTMGDRPVGHRVTVHAMPLLDTATGRIAYDARGSGPAVVLLPSGAHHRRDYDALRALLPDRFRSIGIDWPGHGESPAGSRAADEPHLADLVEQILDQLAPDGAVLVGNSIGGNVAARTAARRPALVRGLMLVDSGGFEPPRLHSRMFCALMGRPWFARAVYPGFSRWYMRSRTSADRRARTDAIATTRTAAGLTAVTQMWHSFTLPEHDLRGLAGRITAPTVVVWGRHDPVLPLAAARNAHALIPGSSLVVIDSGHSPHTSDPASVAAHLVPLLDAAFPAKGPSTTRQ

SEQ ID NO: 15333 - protein, 181 aa, Actinoplanes utahensis
MGTPRTPATRHRWPRTSSPFSTRHSPRKVRAPPDSKDPRTFPAAIPSRHGDHPHPTVPGGRPELSTLHARAFNADPSAIRPWSRRLSRHALTWIGAFDDDRLIGFLQVCWDSGSHAFLLDTAVDPDHRSQGLGAALVRAATAEARAAGCEWLHVDFEPHLEHFYLDRCGFRPTPAGLVHLA

SEQ ID NO: 15334 - protein, 204 aa, Actinoplanes utahensis
MGTTRTPRDRWIEAGLQALAVGGPDAVRIEVLAKKLGVTKGGFYGFFADRDALLSAMLDVWERESTDEVIDHVEQEEGDPKTKIQQAGRLTFSHDRLLPIDLAIRDWARRDEAVAARLRRVDNRRFALLREMIGTFCSDADEVEARSLLAFCVAIGEHFLAADHGSRTRAQVRAHAADLILNRHTAGTTPSDASARVDRKPGHE

SEQ ID NO: 15335 - protein, 171 aa, Actinoplanes utahensis
MFVVTASDLHERPSGDLIKIWFKFVPREGWLPYDTEGLWATQLGEDTARVANVAFLQNGIAQGDVVRFQTNEDGFRWATDRVEASGHCVIRILPVPSGPLGRSASAVQAAFARFGLGGEVFSAELPFVAFDVPADADFGEIQQVLADGESQGWWHFEVGCGTDRWWSSAAS

SEQ ID NO: 15336 - protein, 343 aa, Actinoplanes utahensis
MAGLSRTEPVIYCRTGCGGCCDGPFATRCNDDVVTVDTGRAAYDDGVPERSWEVEPGSGVGPLRFGTSRGELHALLGPHRAFRRSPASDLTDQFEAGGLMLTCSEDEGLHLIEIPDPDGVHYRGVRLSGTVTTVLAELRAAGVELTADDSGWLFADGAVGLYTPSSEPDARVEAVTMFGPGHEMTGEIVFFPAGSEAMPPVSSYVVTPGTGVGPITLGMHRDEVRRRLNGGLCFRNAAGSREPEQDEFFEDHLTVRYGPDLLAVHIYVNRADAVLLDGINLMPTHPLTIEDVRPLLIRAGRTLAEREAGIDIVGTGVEMRTMGPLSSGYGPLPVACVAVALQP

SEQ ID NO: 15337 - protein, 169 aa, Actinoplanes utahensis
MLRPQKVVAYVVREGRLLVFLHVDDVSFDQSGLQVPAGTVRAGELPEAAVVREAAEETGLPGLRVERYLGVSEFDMRPYADAVHVRHFFHLTVDAPEVPERWFTEERGDGDGTPVRFECYWLPLAQGHVLAAGQSALLGRLFDGVSGGAVGSGLQGDGDTGDRKRSVAG

SEQ ID NO: 15338 - protein, 185 aa, Actinoplanes utahensis
METSALATVIPLVGVALGAVSTFFGQYIALRGQRRDRQEELIAAARAETRRAILSFLSAAQDVEREVSRMKRGLARRDEIADELIGDLWLAKKTLELVSSPELSQCAHDYTSVLESLVWDSVSSSAVQEKRERRWRFMEAARHEVGAGVRSIDRWSVSERLSGKPLAPGNSSPTASVEREGVQPS

SEQ ID NO: 15339 - protein, 186 aa, Actinoplanes utahensis
MTTFLVLLRGINVGGKNKVPMADLRTLLGECGFLDVSTFIASGNVILTSDRDAGQVAARIEAELPEAFPLDSELVKVLTLTGDQLRAVVRDRPAGFGDRPDTYHSDAIFLIGLEAAEVMPIFHPREGVDRVWPGNGVVYAQRLSAQRTRSRLSSMMASPLYRSMTIRSWKTTVTLAEMLDARTARP

SEQ ID NO: 15340 - protein, 177 aa, Actinoplanes utahensis
MSVPLTLLGLLERAPSHGYDLKRDYDTFFGVGKSLPFGQVYATLSRLTRDGKVVMDEVAPGDGPERKRYVITEQGATEVNSWLSDPVTPEPHLQSILFTKVVLALMLDRPAEAYLDAQRQAHLVRMRELTAVKRSGDLVETMLADHGLFHLEADLRWIDTTSARLDALRTQIKAGKP

SEQ ID NO: 15341 - protein, 227 aa, Actinoplanes utahensis
MTAALTATGVALSFGATPALRGANLAVAEGEIVAIMGPSGSGKSTLLHCLAGILVPDAGEIDFEGVRLNGLTEAARSELRRDRFGFVFQFGQLVPELSAVENVALPLLLGGVKRDPAIRQAREWFGRLGIEGLQGRRSGELSGGQAQRVALARGLVARPRVLFADEPTGALDSLTGEQVMELMVTSAREQGTTVVLVTHEARVAAYADRLVMVRDGKVTSPSEVPVS

SEQ ID NO: 15342 - protein, 728 aa, Actinoplanes utahensis
MISLGLRLAVAGGREAITRLVVLAAAVAMGVGMLLATIAGINAVHAQNMRYPWLNSGVTSVATGPQAPDPAMWALREDYFHGHPLARIDVAVSGPHGPTPPGLAALPGPGEYDVSPALDRLLRDHPADELRDRFAGRQVGVLGDAALPSPDSLIAVVGGTREEVGRITGATEISRMVTIAPDKCDGCVVGLGERGIVLTLSVVTAALLFPLLIFIGTATRLSAARREQRFAAMRLIGATPRQITQFAVLESTVAAVTGAIAGFGVFFAARAGLAQIPFTGEPFFPGDLSLSVTDVLAVLVGVPLAAALAARIALRRVRISPLGVTRRVTPKPPRAWRIIPALLALAELGYLVNHRPNTTQGQTIGYLSGIFGVLIGLMIAGPWLTMAGSRLLARRARRPATLIAGRRLADDPRAGFRAVSGLMLALFVTTTATGVITAIVAERGGGPVGARGHDVVWMELGADREGLPPTQVHVRAQRVRANPDARPDNDHLPGLIACADLANIPGSGTCPAGAEVAEVFTDLSTSTWLPHTAAGSTWPAARQTTAQLGALNVLSALIPTDGSPAAIERARTTLDNAFPDGRGAGTEADFRGDFTRQLSQFERLADVVIIASLVIAGCSLAVSVTGGLTERQRPFAMLRLTGVRLAELRRVIALETAVPLLAVSIVAIGAGFTAAHLFLRSQMQYDLHAPGTAYYAIVSLGLLASIALISSTMPLLRRMTGPAAARNE

SEQ ID NO: 15343 - protein, 153 aa, Actinoplanes utahensis
MAGTLLPWPEIEKGAKEHPVPTLQYLLRARGQTIAVDGIFGPETETAVLTFQRANGLSADGIVGPHTWSALIVEVRRGSEGDAVRGVQEEFQYRNLSGIPGNGLAVDGIFGPRTEAAVRAFQTAVHADVPTLTVDGIVGPMTWQALVSGMYSF

SEQ ID NO: 15344 - protein, 203 aa, Actinoplanes utahensis
MTPIRILLADDEHLIRGALAALLGLEDDLTVVAQAATGAEALSMARALRPDVAVLDLQLPDLDGVAVARALHDELPGCHTMIVTSHGLPGHLKRALAAGVRGFLPKTVSAETLAGVVRTVHGGGRYVDPQLAAEAISAGDNPLTPREADVLELAADGAAVEEIARRAALSPGTVRNYLSAAVGKTGAANRHEAVRIARGHGWI

SEQ ID NO: 15345 - protein, 399 aa, Actinoplanes utahensis
MTVAAWWRSRGRAARLDLYLRGTLYATFAAAVPLAAGSVPGRAALWVAAAVATVHTVLSVLLVRAGVDHYLGNRPFPARLVAAGGALTAAGVAAAVLVYPDAAPGQPDGPANAVLLILVVSYVAALSTAVRPVVALAVGGLGSLALYALAAGQGAARPGAPALAMVIVTGFVVASFRVTVWMLGALWELDRSREVQAKLAVAEERLRFARDLHDVVGRTLSVVAVKAELAAQLAKRGRDEAVDEMLEVRRIAQESLAELRAVVGGYRTADLDAELAGARSLLTSAGIACRVIGDGGGLSAAVQGTLGWAVREGATNVLRHSEARHCTVALRLSTDGTVTLTVDNDGAAAGDARVRFGSGLIGLAERIAGMGGTLTAEREPPEGFRLTAQLPMAAEEATA

SEQ ID NO: 15346 - protein, 263 aa, Actinoplanes utahensis
MTHLTGTMRRIRAIGRAELTLLLRDGMALCNAVVPPLAIVGLAAAAKADPGGLPGNAFRVTGLLGLVLVGAVYFTLVGTYVARRERLVLKRLRVGEITDVEILTGTASPAIVLALAQIVVFTVAGAVFLGLPVPVNAPVLVLGALGGAGVFVLLAAASAAFTRTVELAQVTTMPLVLACLLGSGLMMPLDDLPGWVGEVVRFLPLTPAVELMRLGWLGTTGAGAPVGFVAVFAAAAGPVAILAAWAALGAVAVRRRFRWEPRR

SEQ ID NO: 15347 - protein, 395 aa, Actinoplanes utahensis
MGASARPAPRVGAGRLGAHVVHRSAGAASPGGRRARHPRTGVRHHRRRASGHRRARLPPGLLRPVPAPPAPRAARRAVAGLPRDAVRPMTAAAIEVRGLSRRYGGPGGFEAVRDVSFSVQRGELFALLGTNGAGKTSTLEVVEGQTRPNAGTVRVLGHDPHAARAAVRPRMGVMLQEGGFPADLTVVETARMWAGTLAVPRPVSEALALVGLDHRTAVRTKQLSGGERRRLDLALALLGRPELLVLDEPTTGLDPESRHATWQLIRGLLAEGVTILLTTHYLGEAQGLADRLAIMHRGQVVTTGSVADVVAAYPARVSFGLPAGIPVDALPELPGAHRPESGAGGQVTVHTAALQATLTALLCWADQRGVVLAGLDARSASLEEAFLSIAAGRQP

SEQ ID NO: 15348 - protein, 228 aa, Actinoplanes utahensis
MIQVGTTALHVGVTGHGPDVVVLTGGPGCVQYLERDEISPLGHRAWYPEPRGVGRSGGSPHTMEEAIADLEGIREAVGVSAWTVVGHSWGSDLGMRYAVEHPEAVAALVGIAGRGPQRDRTWSEAYEASKATEPFVDIDWVPEVHAALGESFTEWIHRPSLWRALADCSVPMHFIAAGNDIRPAWSLAQLAELVPRGQFSTVPGVPHDFWFTHPEVWTQTVTNACAAV

SEQ ID NO: 15349 - protein, 115 aa, Actinoplanes utahensis
MGLSVTVAGTSGMILGDWTSSPWWISPMANGVMIFMALYPLRYLKTKVDRLGKADLVYLLTTSVISIAVTAAVVVTLQNGITTYLLAGVASLAVWMSTAWWVGRSRTDAPGTRER

SEQ ID NO: 15350 - protein, 237 aa, Actinoplanes utahensis
MRSAFVLVHSLLLGPLTWAPVAAKLASSGASAVVPSLVDVTDADDPPFWPRVVDRVHNAVARLPPNQPVFVVAHSNAGLFVPAIVHAAPRPVAGCLFVEARLPSRTGPTPTASPERLTHLRTQVTEGRLPQWTAWWDEEDVAALFPDPQTRLTISAEQPRLPLSYYEQQIPVPDGWDRRPCGYLLFGSPYDQMAQDARERGWDVAQVAGHHLHQLVDPDAVAAGIVAMTDRWRLSAS

SEQ ID NO: 15351 - protein, 360 aa, Actinoplanes utahensis
MTTSPLGPDSALLQPVTAGALQASNRIWMAPLTRNRANPDGTPNELQAEYYGQRAGAGVIITEGTQPAAVGQGYPNTPGLHSDAQQDGWRRIAESVHAAGGRVVVQLMHVGRISHSSTIGGQTPVAPSAVRAAGEIFTAEGLQPFSEPRALATDELPAVIAEFADAARRAVAAGLDGVELHAANGYLLHQFLADGVNRRSDSFGGSPQNRARFVVEVAKAVSAAIGADRVGIRISPAHPFNDIHEDDLTVYEVLTSQLAELGLAYLHVLATPDDPIVGKLHAIWPATFVLNTGFGVESDRDGLERLVADGVADAVTVGRPFLANPDLVQRWTLGAELNEPDQATFYAGGAKGYTDYAPLS

SEQ ID NO: 15352 - protein, 116 aa, Actinoplanes utahensis
MHSNLTEHARCRYGDEYRPAVIAQCSEDRDDRYFIERLTFADAEAIAAMLHELCPNIVDGLLPVWVRNLAYRLLLLQRPDDPALMREAAQSLWVHGPDWDDIAAGLECRATALEAG

SEQ ID NO: 15353 - protein, 162 aa, Actinoplanes utahensis
MDDKLSAEDRASAVRGAKVTVGCTVDGANHRPQPSIDPTMGRERTFQERQRVVESAGSGDAIGDLRAAVAKANAELATLAPGPAAYRQRRRQVVRASGRLRERETLAQRRAGHLRDMRLLGVLIGGIVAVAGAGSWVAILAGLGLALLFGWIVGRLPDRMFR

SEQ ID NO: 15354 - protein, 67 aa, Actinoplanes utahensis
MVPADLHAAARRHGVVIGIVAAVTDRTEQALASRRLATLTELAAIAADRGRREALDTALVRLAGPKM

SEQ ID NO: 15355 - protein, 166 aa, Actinoplanes utahensis
MPQLYHVSDRGPFTTMRPRPSPPGTPHEGQELVWAVDEEHLPHYLLPRQCPRVCWAVGGPRRDLLCSPAARVVAVEHGWASRLLAAGLNVHLLDPAGFTLLDATAGYWVSAEPARVTAVRRVDDCFTALAAHDVELRLTPSLWPYVDAVVQAGGEFSAIRMRNAAR

SEQ ID NO: 15356 - protein, 155 aa, Actinoplanes utahensis
MHRRDLGRQQTAARVAELLDLVALPAAYARRFPHELSGGQRQRASLARALALRPKLLIADEPTSALDVSVQATILELILRLHRELGFAALFISHDLAVVEAVASRVAVLHRGRVVEVGPTADVLHHPTDPYTRRLLAAVPVADPARQAARRRVPL

SEQ ID NO: 15357 - protein, 94 aa, Actinoplanes utahensis
MNARPESSNGPSPLRQPRAGDVVRLTTKASVQFAGACAMVFRIIRVDPRETYAGWVWLIGYSIDASGRAIERREVFVQIAGLVYVTTPCVPPAE

SEQ ID NO: 15358 - protein, 513 aa, Actinoplanes utahensis
MRKRVGRNTLSTHSAAVSLDGIGDRQATMDHETSKPWRRDVPLKSEIPGSTWNRPDMLTALQSRDIAHVFRLVRQHAGMSQTAIGSLIGMSQGKVSSIMAGSQQVTTLEVYERIADGLRLPDTARMTLGLAPRSISARDGSHSDATGTVNPTRSVERDPRPEEDNAVRRREFVGLTGAALFGAILAKTEPTDQPTTSGTDDLATALTELPTPAAGPVNLSRLSATVAAAKRVYQACKYGEVLTMLPPLLRSLRTALTATDGAQQRKAQALSAEAYHVAASILLKQGDKGLAWLAADRSVQTAQQTAVPLMIGSSARIITHALMDGGHHRAAATNASSAAQHMDAVLTQPTDNDLSVYGSLLLRGAIAAAHNADRHTTIELLDEAEQAGGRLGHEGNHMWTAFGPDNVLCHRVNAALRFGDAGTAIDFARRIDLDALPINERKAVLLLDVTRAFLIWGKHEQALHTMRAAGQIAPEEITGRPRIHKLVGDLVATAPITVRREAREFADAYGIAA

SEQ ID NO: 15359 - protein, 229 aa, Actinoplanes utahensis
MRVWIGGLGSASTVVFAPVTGHPDLAVAGRHLLVDLIGSGWSDHDDTFGHTVDEHAATVATVLDAVGVAGVTLVGHSLGGSIAISLAAQRPDLVKHLIVAEPNLDPGVGTFSATIAAFDEDTFAATGHGRIVAALRAEPGAVDQEFARTVARWSPRGLHRTAVSLLAGRPATFREQLAAFDGPRRFIGGELSGEDLGPLRDVGCEVLVVPGAGHVMMADNLAGFVAALR

SEQ ID NO: 15360 - protein, 63 aa, Actinoplanes utahensis
MTAVLAALTRPARLIPAGDLFDGGDERAELLDGVAAHLAETFAARIAAVTLVLNDARVRSLLG

SEQ ID NO: 15361 - protein, 232 aa, Actinoplanes utahensis
MESAWWLRSTTHRSAQQRGLGMDSRIERSRQLYERMAFDGDGSGLPIAERELDGVEADLALARGRLAHGRFLRDGQEDPQELAFFARAAELYEALDDSRGAAEALLWIGIFHQFIRDDDDAAMPALHRSRELAEQAGDRLGLSYALRHLGIAEHRAGRLDTAREHLEESTRLRREVDFLPGVAANLVGLSYIAAAQGRRDDAMTAAAEAGRIAGSTGALAIARQAEEALIRI

SEQ ID NO: 15362 - protein, 290 aa, Actinoplanes utahensis
MHSAGWHLTEDVDHFLVHAGDFLRSRPALHTMPLTRIETFRTRTADRAGAVFGWLESGGGVRAFFYRLRPFGLLTLTGVSREQSDTLAAELAARGDSLNAVHAEHDTATAFAEAWNRHTGADPLLVARTPLYRLDRLTPPRRPAEGHGRTADARDHEHVVRWCREFCAAVGEDRSIQMIDVGDWAASRFGDKHYTFWETPDGTAVSMAGWTSMVCGMVRVDPVWTPAHYRGRGYAGAVTVEVSRAALTAGATDVVLFADATNPTSNALYQRIGYVPVADFALYRLPRTAA

SEQ ID NO: 15363 - protein, 231 aa, Actinoplanes utahensis
MPITFPTHPAAVLPLKLWRPGWFDGVALALGSAAPDVAYALDGSGLPVWPLSHQVRGLVLWCLPVTLLGCLLVRRAVPVVAAHLPGGDRLALRDYGALRSSAHPWWITVLSALIGAASHLALDGLEKLMPAVELPGHAVGAVTMTVLLLVIGRRRLIRRWHGAPPVRERRPLLFWSVAAAVALPVLTVTPLLPGAGLLHTTGVRILSATALGLLLGAAAVGALHPEPARTS

SEQ ID NO: 15364 - protein, 102 aa, Actinoplanes utahensis
MLRCERPPLTKELDVHVSGIITAIIIGLIIGALGRLVVPGKQNIPIWLTIVIGIVAAIVGTFIASALGVNDTKGIDWIELLIQVVLAALGVGAVAGLYGRRA

SEQ ID NO: 15365 - protein, 296 aa, Actinoplanes utahensis
MDVVVVGAGIAGLSCARALADAGASVRVVERGRVVGGRLASKRYGGRYADIGAAYLVADDPDFAAQVAGWQAAGLARPWTESFRVYPGGRDATGPVRWAAPDGLRSLATDLAAGLDIRLSTPLDAVPADADTVVLAMPGPQALRLAPPPGIAAAAAAQTWHPAIVAVLRYPLREWDDLRGAFVNDHPILATICDDGDRRGDGAPVLVAHSTAELAARHLNAPEAAGPILAEAVGELLGLSAKPEVSVHRWTFAQPEPGKALYAVDGRVWLCGDAFGRPRVQTAWLSGRSVAKALLG

SEQ ID NO: 15366 - protein, 172 aa, Actinoplanes utahensis
MPVPDPGGPSPGAVFRRWSPSAGTVAQVTDELWDSYDRDKLQAGWSYPVGRTTVEATLRAAGVHLLSLDFIMHGGATTDPLLLRATRYRDMGNTYFLQRGTSERSRCVLALYAVPSGVRAQARAVLTTGGGLDRACAWLAAAEAADPTWHYKSHGWTASLINGALQIAETTE

SEQ ID NO: 15367 - protein, 525 aa, Actinoplanes utahensis
MSIDTAGIADAAIEAALVVLEETPRQDLDPRPTLAEAGRLGRAALRGGRCDLGMRARLLEADAVSRTGDVATGARIFQEVNRWAVEHRHPRLLALSHIRLSLFYSHLGDTVVALDHAIQAQQALAAMGAEASPMLRLRGTVQLANVHGDNGDHASARARYAEAERMSAGQIAAGRVDARVRITVLNNLAYTEYEVGDIDAAEAAADRLLAAAAFHGLDLDHSGVDTVARIRMNAGRHAEAIALLEPLVAVETDDAFSELNTTASLLLTLAETYRRCGDYPAAGAALDRCQTLVDQRGLRSVGIELLRERSEVLAASGRHVEAFEVHKRFHAAAMAAQSAERDARARTLHALHQLDEATGLREMALRDPLTGLYNRRYVDAELPLLLHRAAENGEPLAVAVVDLDHFKQINDQGSHEAGDRVLREMATLLTAAAGAGGSFTARLGGEEFLLVLPGAGAAEAAERMTLLCETVRRFDWRPITGDLPVTASIGIAVAPLGRAGSAELLHEADSRLYEAKRSGRDRVAA

SEQ ID NO: 15368 - protein, 213 aa, Actinoplanes utahensis
MSSAGSGRPRDPEVDRRITRAVLDVFGEAGWAGFAMETVARRAGIGKATLYLRWSSKEELLTDALTTGLVRVGDVDTGTLHGDLVELATQVLGLYTGPAGRAAMRLNLETAIPEVAEHYRTMRASQIQAARDIVRRGVARGELPGTVSVSLLLETLIGGAMMHAMTTPADRRAALAEEAGSHARQLVDFLLHAVASPVADRRARTGPLFRAPA

SEQ ID NO: 15369 - protein, 143 aa, Actinoplanes utahensis
MGPGVIMVGIDGSESSRRAAAYAVGLARREGARLVGVYVRPPAGAMVSMADSSGTVAATMVASQDAVVSEFRDTLQQERTRLGVDMQIVVRDGDPFTELCHAAREFWADAVIVGRSERLLHRIAGSVAQRLVRCGRWPVTVVP

SEQ ID NO: 15370 - protein, 475 aa, Actinoplanes utahensis
MTLTTPLRRRLTAAAALGALLFFGGVHATAAQAAVTRTRAGNQADVSRTGWNGPAFVFSGAGAIVPATFTRAVTAITGGAGTMDVVVLADAPPGSGSATPECDAVLALAGVNACTTLVLTSARDGDDAAVNTEIRNAEFVYFAGGDQCAYAAWKSTALRASVQSVVAKGGGVGGGSAGTHINSDIVYDACGGSVTSAEALADPYTGAVTFTTGMFSWPHYAGTINDSHFVTRDRMGRTMAFVARSLKDGLVTGGKAWGVGIEQGGSLFVDRAGLATLAGADAYIVLGDHAPEQAVAGRPLTYTGFKIWHLTGGGTFDFANRPTCGYYLRSVTAGVADPGLYSGTPIADCSGGAGAVTETEPNDSRGTANDLSTGTYPLTVSGSAKSASDRDYFKLSLTQNQKVTVSCSIPDQYDADLYLLDGSGAGLARSVNDGKGADERLTYTRTATGAGSYYLDVEAYSGSGTSPYACAVVKG

SEQ ID NO: 15371 - protein, 402 aa, Actinoplanes utahensis
MVTRRTLLAGSAAAATAALTGTPAAAAARPATGPLILAGGGLADDNAAVYGEIVRRAGGAGAYIGVLTAASVPPSQDPDAGTPDASNSAANGEFYRRLLLSYGAGRVEWIPVDLDHVGAADDPQLAARVATMTGFFFGGGDQFRYVTCMMHGAAHTDSAVLAAIRRRHRAGAVIAGSSAGADIQQGHDMVTGGDSYPALRDGSTAGYFDDSSVSGYWPAGGFGFFTSALLDTHFNAYGRLGRGIVLARTVGRHHLVGVDPDTAYLVEHPGTAHECGQVIGTGGVNVIDLYRDVRWSFLTAGYHYQPGTGRITPPPAVRPLRADPAHRGVPDNNDIFGDHQQLNLALALTAADTRRAVGYTAQSDPRFAVTLTKGHDFRGYTRDGRTADSFLDLTVAISAVPA

SEQ ID NO: 15372 - protein, 293 aa, Actinoplanes utahensis
MSTPNEDLGPAVGVAGLIRARWAECSPAERKVARVLLAAYPQAGLETVAALAGRAGVSAPTVLRLAGRLGFTGFPELQKALRQELTERDVSPLTTYSAGRSTAAADGGALERAAAILPGVLATALAETPPAEFDAAVRLLADRQLTVTLAGGRFSRLLAEYLLLHLMQVRGGARLLPAGAVERANTLVDVGRRDLLVIFDFRRYEDWSLALARAATEAGARVVLVTDRWLSPIAAVAEAVLACPVDSPSAYDSFVPALAVLETVIAGVIDRLGAPAGERLARIEEASRRFTLL

SEQ ID NO: 15373 - protein, 318 aa, Actinoplanes utahensis
MRIRYPRQTAVLAAVGTALLLTACGSTPSTATTGGSAAATPVTVTIAGAGTVTTDPALAARVPADARAKGSITVATNAPYAPFIDFKTKGDQSHFVGLDYDLFTAAAARLGLRATFQQQPFDGLVPGLQAGKYDAIAGGVTDKREREQVATFVDYTASGTGFLVTAGNPKQVSTVANLCGLRVGAQKASNQVDNLTAYSKASCPGQPIVISQYPANTDAVQALLAGQVDVVAATRVNLTDVVTQLSGKVALADDPAAPNGWLASPNGFGFLKSRGELATAFQAALQSLISDGTYRKILDQWKQAPIGLATITVNQPIN

SEQ ID NO: 15374 - protein, 297 aa, Actinoplanes utahensis
MSVDADAATAASVAGTPLRVVPLRRPGRWVAAVLAVAGLAAFLQALLRSPNLRLDVIGEYLFKPYILHGVLTTVWLTVVAQLLGTAGGTAIAIMRLSANPVLRAVSWLFVWVFRGTPLLVQIIFFGFLGALFPTLTLTVPFSGDILWSRPTSVVITGTVAAVLALSLNEMAYAAEVIRAGILSVDRGQLEAAYALGMRPRLTMRRIVLPQAMRVIIPPMGNDTITMLKSTALVSVIAGSDLLTVVQGIYTANYQVIPMLIVAALWYLAIVSVLSTAQFLVERRFGRGVTTTNRGITR

SEQ ID NO: 15375 - protein, 395 aa, Actinoplanes utahensis
MTVTPPDPGYLQRLETLVNIDSGSRHLAGLSAVTGLLAGWCEQAGMTTTRHPVDVAGDPHGDVLVARIRGTGTGRILLAGHLDTVFPPGEAARRPFAIRGDRAYGPGVADDRGGLLAGLAAVQALQRDRRHTFAEIVYVATPDEEIGSPASRALLAELAGACDVALCLECARENGDLVNARKGMTDIQITLYGRAAHAGIEPHRGANAALAAARLTVALQRLNNTGRDVTVNVGVLRAGERPNVIADRADMLVDVRASDDDTFRRTLRQIEDLARARYVEGVSASVAFIAPTPPWHGTDAALLDAARAAGAATGVPVSFTGTGGCADANLIAGAGIPVLDGLGPVGGDDHSTDEWIDLDSVRPRIALLAELIATVPTGRSADSPSRAGLHGHPVR

SEQ ID NO: 15376 - protein, 1149 aa, Actinoplanes utahensis
MSDADPAMRDRPAAREPAAAARAAQIRAERRFRSLVEATDTVVWAHDASGAITEEQPALAGYTGQPWPEHRETGWLAMIHPEDRDRVAGDLRGLPGRTAPLEQRYRLWRAGDQAYRHVVGRAAAIQDEHGVVVEWLGAITDVHSQVEAGVAVRRTTAIIDAILQEAPVGIGWADLDLRLRHINPALARINGLPAGDHLGRRPSQLWGETGRRIEELMRRVMVDGPVTGVEFTAPEPESALVRHRVASYFPIRIPGSDQDVGVGFTIVDVTERTRLLQALGEQRTRFERLLTTDVLAVFGGVDEAILEANDAFLSMLGYTRDDLEQGRLRWPDLTPPEWAEADRRSLAELAATGRSSAFPKEYRHADGHRVPVLIGVVALDRAPLRWLAYAADLTAERSAQAESRLFRALVERSGDLIAVARIDGSVRYVNPAGLRMTDRTAAPERLTDLIGEPLQPRETAREPRRHTARALPTGRGGAPLEVDLQAFTVAGDTETTPYLAVVARDMTDRQRTLRQAEGLARFAGALSTATDRAAVTATVEGLLPAVVEAASATWIPASDPAGAPDDAAAFVMPVPLEAGTVAGSVLIRWDRPVEIDELRNVLQTVAGLSGQALQRAELITAASGMATLAARLSVTRTPDEAIAVMLETIPAALDTTLCGLLVREQGDRLRMCHRDLPAALAAAYTGLRLDDPQPIVEAIRTGRRIVLPGREAYRDRFPAVADIVAGHGIVSTVALPLHDSQGRTVAALGLGWPYRRPFGTDGLARLDTVADLCEQTLERTRLVATEHQLITRLATRLHPASAVVPAELDIAVRYRPALSGLELGGDWYDLINLPEGRFAVVVGDVVGHHIDAAADMAQLRTVINTLIRLEVPLEELFARFTTLVGRDFWGTAVVLVLDPARQRADIVRAGHPHPVLLGPEHPPTAVATDRTPPLGLVNRGIPVTSVPFVPGAALLAYTDGLVERRHSDYDRGVDDLHAVLAGTAADACADDVADAVLAAARASEDDQALVVVRHRPPHRTDGVDVRVPFTGETIGGLRHTVQAAARAAGLSPERVEDFTIAVYELLTNAVRHGGGGGELTLRTTATALVCEVHNDATTGGDVRVGPVAPAPDSQGGRGLWLASRLADELDLRLTRSGALAAALVMRLGT

SEQ ID NO: 15377 - protein, 762 aa, Actinoplanes utahensis
MAAPDAGTCCSYRVTNHDKPGDPSAAVLRWYLGLGVIVVAAILLAPVHLLMWLYMAVAVGVLSALVTGIHRYRPVWSRPWWLLVGTVGVSVLANTVWALMMTPAGIPRFPSLGDLCYLVAMGLLVSSVYCWVPGRSRDGLIDTAIALTGGGAVVWALVVTPLLSSGRFGGLRLASYLLYLGIDLLILALTVRVVVVSRVRTAAYRLMVGAATLWATTDITYYAVLFHRPSAPPGWIQVGWVSTYLLIGAAALHPSMARSTGSMPRNATPLSWLRLSTYVVLTVLVAGLGILGTASAAPAGTAWRLVVPLFLGCATSVLLIGRLAQLGAALNQRAYLDPLTGLGNRAALQGALERRGTDDRVLLVLDLDGFRDINAAFGHKAGDAVLVEAGHRLRAAAPSDALVARLDADSFAVLADGADGVLHRLAERLRAAVAAPYPVPGLHHRRVRASVGAVVVGAGQDGTTALRDADLALQNARAQGDGLALFNPAEYAQWRANRDLIADLQHALGADEFAMHYQPIVELATGRIIAAEALLRWTRADGTPVSPGRFIPLAEQSGDIIVLGEWVLARVCADLAGLWTDFQLPVTVNVSAHQLRDTGFAARLLTLLADTALPGAALIVEITETVLVTTVTDAATTITQLQQLRDRGVRIAIDDFGTGYSSLAYLRELPVDILKMDGSFTSQQIADGGPREIAFVRTIVDLGRSLDLSTLAEAVETQAQADRLRELGCDLAQGYHFARPAPVGRLHELLAAQRCGISDTAA

SEQ ID NO: 15378 - protein, 260 aa, Actinoplanes utahensis
MRTRVDQISDRIYRISTCIPDIAPGGFTFNQFLVDAEEPLLYHTGMRQLFPLVKEAIERIMPVERLRWISFAHVEADECGAVNNFLAVAPHAQVVHGDLGCQVSLNDLCDRDPRPLADGETLDIGGATLQRRLIALPTPHVPHNWESHMLFEQETRTLFLGDLCTQFGDGPPVTDQAPFEAIIAAEDLFHQTSLGPAVLTTYRRLADLEPVTLAVMHGSSYTGDCPTLLRMIADIYQERYGCGTPLLGQPLPAHKLVGSD

SEQ ID NO: 15379 - protein, 122 aa, Actinoplanes utahensis
MDSTQLRVDRIDVWQTDREHTLSLAAAGVHVMLVRLRYDGWVDEVINGAGTVAPGPGAWTLIGRRLTLEFDPRAASALGFHRDCQLYLDVDADGIRRVRAALLEILDCACFVVDTDEGRLTS

SEQ ID NO: 15380 - protein, 227 aa, Actinoplanes utahensis
MPSWTRSTSPERPGNMFGGTAVAHHVVINFAVLGDSIAYGQGASRAADTVAARLSADLTAAGLAHQTRNFAVPGARSAGLTAQLTAAVAWPPDLALIIVGANDLTHLVPAPEAAAQLEAAVRGLRAVGAEVVVAPAPDLSVVPRLPAEMRPAVRAASTLLHDAQAGAARAAGAHVTGIGISSAAGFAADPGLFSADRFHPSSAGYAVIADALAPTVRAVARSLAVAR

SEQ ID NO: 15381 - protein, 465 aa, Actinoplanes utahensis
MIVSRIPRGALLLAAGLLTAATAAPAPTLAATSSPTAAAPSADVAGPVIDENFADPDVMKAGHTYYAYATNSDGRNIRWATSTDLVGWTVQAGDALPALGAWADPTWTFPPGGAGDHGVWAPEVFAAGPKSFVMWYTAHDRTSGKQCIGAATATSPGGPFVPRDAALVCTPEIGGAIDASSYSENGRRYILWKNDGNCCAQDTWLHLQQVSADGLRRIGTETRLIKQNKPFEGTLVEAPTLWKHGKTYVLFYSANFFGNGSYVSSYATSTSLGGPYTKAEAPLMTTDAFAGSVRGPGGQVVATGPDGHDRILFHGWDATFTYRAVYSQRLDWLGDRPVVAGAKIRYEAEDADFTRANARYAVGGASNGVVVGGIDFADSRVTFTVRVPRAGTYRLYTRYANGSDAGAASHTLTVNGAAAGTVDYPVTGWDNWQTSEREVTLRAGTNTVAYGKGTNYAELDAIDIA

SEQ ID NO: 15382 - protein, 343 aa, Actinoplanes utahensis
MRTHLKRGVAAVTGLVAAVAVTGTPAQAAGSGSKVSQTTTVGIHNTYDPATFAYLAQALDQRPGLIELDVWPDVITREWKVSHSNPLGNANNCVAATSASGLYSGRANKNLEYCLDDIRLWLAAHPDAGPLVLKLELKTGFSGRTGQGPAQLDAAIAAHLGAAVFKPADLLGSYASLDAAAKANAWPTRAQLAGKVIIEVIPGTVEEGNPTDTLWTDTEYARYLASLKAAGTLSRAQIFPAVHNAAKGDPRTRYPDTSLRPWFVTFDGDANTYVTGGIDTAWYDTNHYLLVMTDVQNIAPVVTAGDTAAAKARVAQVAAAHASVASSDWSSMPAVDAIVADRG

SEQ ID NO: 15383 - protein, 49 aa, Actinoplanes utahensis
MIDLDGFQAVTRHLRPGVRGRTAVGRKARGRALFARGSAAGMDMFMIFD

SEQ ID NO: 15384 - protein, 437 aa, Actinoplanes utahensis
MSAPPSRPRRPLFGRGSWPEVSRIGDILRAETVGGALLLCAAVIALIWANSPWSAAYQALVAARAAVPALHLDLTLAQWASDGLLAIFFFVAGLELKREFVAGDLRDPRRAALPVAAALGGMAAPALIYTAVNVTAAGGVPSGWAVPTATDIAFALAVLGVIATHLPAALRTFLLTLAVVDDLLAIVIIAVFYTDALHPLPLLAALLPLAGFAVLVQRRVRAWWLLLPLAAATWVLVHASGVHATVAGVLLGFAVPVVRRAQGPGPGLAEHFEHRWRPLSAGVAVPLFAFFAAGVPLAGAGGLGATLRDPVTLGIAAGLIAGKCAGVFGATWLVQRTTRASLDDGVSWWDVFGLALLAGIGFTVSLLIGELAFGAGSVTGEHARIGILAGSVTAALLASVVLRLRNRHYRRLCAAEAVDTDADGVPDVYQHDAHPEV

SEQ ID NO: 15385 - protein, 153 aa, Actinoplanes utahensis
MTRPDVPADPDDLREEIQQTRADLGATVEALVAKTDVKGRAKQAAREKVETAKAKAAETVETAKVKAADTVETAKVKAAETVGTAKVKAADTVETVKAKSTEIAGTAKDRIAEAKSTVVEQTSPATRRAVPPAVIAAAALLGVIVLLLRRRRR

SEQ ID NO: 15386 - protein, 145 aa, Actinoplanes utahensis
MSDSLRTGTPGTASTADLVSQAAAQISTLVRDELALARAELTEKGKRAGVGGGLFGGAGVLALYGLGLLLTLAVVLLDLVLPLWLSVLIVAVVVFAAAGVAALLGKKKLAEATPLAPKAAIDSVEADVKTVKTAAQRGRNHYDQA

SEQ ID NO: 15387 - protein, 877 aa, Actinoplanes utahensis
MSPRQRKLLISSVALVTVVGLIPSGAAAAPGGQPRPEPYQRHVQAAQQRAALHAGFSSRSAKADEDEGEDPEEIAEQAEQYAEARSAPGIVAPGAYTAAWQQLRSLKSTGGTWQQVTDRPYNSDDPRYRDVNSNSSGGAGFVTGRVTGLAADDHGFVYAGAANGGVWRSRTGGGHWQPIAERVPSPSTGDLRLDRSGRLWWATGEGNTSATSFVGSGVYVLSHPRTGRFTTRDRVGGTELESTIIRKLRIFGDTAWVATNRGAFSHSIKKLSGPWKQEFVPNPDFLPGGAQAGDANAPYKNIVNDFAADPKDPSKVVIAAGWRSGDTYNGFYTRVGGVWQRTTLAGDIASDAANVGTVTFAAAADGSRYYAIEESPTQLTTNPDSALQGIYVSASGSPFGPWTLSADYHKLAASGSALTDPGYMPGIQAWYNQFLQVDPTDANHVYLGLEEVFETTDGGANWTVPGPYWNFGFPCWSIDPGKQTGDCHQTVHADQHSVTIGSNHGRTYVVVGDDGGTFRRPVRGAADAAGHATDWTPLNDGSMDVLQYYSVGVGRDGKGLAVSGGLQDNGQSILRPGDRAMGSNFGGDGGDTIVDPGNGCNIAEEYVYLDVWVTNNCAVNDGAWTTDRSKATSYEVAPPDNKTGEARFIAPLNQDPRDATVWVAGGRHVWLNTKGYAIRSGAEWTNLFDLGAGHTATAVSTSGGLVYAGWCGPCNNQGFTRGIAVGHTDGTGWHQLALPDLPNRYVSGFDVDPANPNHVVVAINGFSRRWTEGPGAGIGHVFESTDAGEHWTDISGNLPDIPADAVKLVRGGGLVAATDNAVFYRPAHARSWLVLGRNLPTTATLELRTDPTGRTLYAATHGRGIWSYDVSKLPRSR

SEQ ID NO: 15388 - protein, 342 aa, Actinoplanes utahensis
MSNDPPQLLDASLTHGDAGAATGGSSPAGWYADPGGTSTFRWWDGQQWTGFVQPAPPAPPVVEPAIGEPVVAAGTASPASRGRSPRRATVVVAAIGAAVLVAGGAIAAVVNSSAESELCGLIGDRQSFARAAGDDADDVGRVAAVAERIHTLAGRLVFSRDLKDAGAGFADAVQTMVALRRAGFDDTATAGSATTARMAETAVSAVENLSRMQRSCGLPVTGQLAADTGASAETADRAAQSDVRGAIAAVEEAYTEMGNTYPDTAIAGDNSSGGTPQVAVGSSTEKITLSDKTKLYYVPTSADTYRICATNVGGSGKWYRYDSSQGGSVGAVSPPADPASCA

SEQ ID NO: 15389 - protein, 181 aa, Actinoplanes utahensis
MPSSRTANVTGRAPRSVNGLPAHILLVHAVVALLPLSALLLALTALWPAARARLALFNVVLAWVVVLLTPLTTSAGEWLEQRVPRSDLVHRHAELGDSAIFYALPIAVLAVLVWWRHREATATPGGRAFLAPRSAAVTGIVTVLAVAAAAAGVYGMYRIGDSGAKAAWTGGFSTTDTGRGD

SEQ ID NO: 15390 - protein, 76 aa, Actinoplanes utahensis
MTLAVRDDGTGFAPADAGRLFDRFARGHGDQRRFGLGLALAREVVTGHGGVIEAVGEPGRGAVFTVRLPAARTRSD

SEQ ID NO: 15391 - protein, 123 aa, Actinoplanes utahensis
MTAVAMLAALVAAGGWGFSDFLAGVLARRIPVLTVLIGSQIAAMLVVLPAAAVHERPAAWDGRLWLGVAAGLVGLPAMGLLYRAMRDGSPAVVAPVATVAAMVPVGWGLRHGPGVGTVTWLAS

SEQ ID NO: 15392 - protein, 111 aa, Actinoplanes utahensis
MHEAGAADPFWALAGARVSGGAGALLLALGLRERHTVRFRSPILLVGLADVVADGAFLVAAAAALAPAAVVTSLYPAVTLLLNRWFLRERLHAVQLYGVVAALFSVACLAR

SEQ ID NO: 15393 - protein, 234 aa, Actinoplanes utahensis
MQPSNTAPPARRGGLAAALRTWVPTMVFNLVLPLITYQVLTGHGAGEVTALLASGVWPVLETVVLLAIRRTWDEFSIFTLILLLLGVVSALGFNSPRLILVKESAITGLFGVALLVSLLAPRPLMFYFGRKFATDGTPESIAWWNGMWQFPGFRHSQRLITIVWGITMLSEALIRIALAYVLSTGTMLVVSSILPYVVFGGLVFWTVTYGRRQGRRAAARQAEEAARQAEANPA

SEQ ID NO: 15394 - protein, 452 aa, Actinoplanes utahensis
MRPLSAIVWTVPILAAGPASAVPVAAAPAPAPGGYYLQSVITGFAAAATGDTLAQHRPKGDEDHQQWTLRADGDAWRLESIDGPGRCLGRTATAPAMLPCADANTRWQITGAGDDQYLVRDPGAERYLSLVPGGAGWADQLGLDAAGPQAHWYLTPLTPVRAALPAEPDRTLDQVTFLTAHNAYANGADGGFAPPIINLFPNQVRGIDRQLADGVRGFMLDVHQTPDGAILCHDSCTLVSRPVALWVDLKRITDFLTAHPDEVATVFLEDYVDPGVLRAELARVPALPAMLLRPDLDGVRERGWPTLAELRRTNHRLLIFTDHDRAADQAAGLTRDSFGVQYQREWTVENYWSMGSGAGASDWSCYSRWPGAGPAGIPLTATAPGFRPLFVMNHFRDVPMAATAAGDNAKALNRAERFCAPAARKKPNFLAVDRYDLGAAAGAVAQLNTYAY

SEQ ID NO: 15395 - protein, 515 aa, Actinoplanes utahensis
MTAGTALNAGRRARELDELAGGATVDLLVVGLGVTGAGVALDAASRGLSVAAVDAHDLAFGTSRWSSKLVHGGLRYLAGGHLGLAYESAVERDILLRRVAPHLITPLPSVIPLTPLLSAGQAGLARVGLAAGDLLRAGAGTPAGRLPRSRRITPVEVHRLVPAVRRSGLRGGLLGWDGQLVDDARLVVALARTAAGFGARVITRCRVEELTGGGASVRDTLTGERHRLRARAVVNATGVWADRLDPTISLRPSRGTHLVLRPGVLGRLGAGLTVPVPGTTSRFVFVLPQADGHAYLGLTDEPVEGPVPDVPEPTPAERGFLLDVVSTVLDVPLTEADVVGAFAGLRPLLAGGAGSTADLSRRHAVVTSPAGVTTIVGGKLTTYRRMARDAVDAALRSAGLPAGRCRTAGLPLVGAASPERLAGSGAPRRLVARYGAEATAVAALAIEDPGLAEPVAEGIAVTGAELLWGVRAEGALDAADLLDRRTRIGLVPADRTRAAGVAETILRRGLAMQGS

SEQ ID NO: 15396 - protein, 196 aa, Actinoplanes utahensis
MSSRNTPGSRTDDDALLDAARQCVLAVGLRRTTLTDVARRAGVSRMTMYRRWPDMASLVADLMTREWGELALRAQEGAAGRHTRDRLVNGLTTGATRLRHNAVFRRILELDPEVLLPYLVDRRGTSQDRMLALLAETIAAGHADGSVRTGPPALLGRSLLLTLHGFVVSSATMTDEVTEADLDTELRLLLDRYLAP

SEQ ID NO: 15397 - protein, 520 aa, Actinoplanes utahensis
MNELTDPARWGTPAAAMTLSPTVLDILGSALGVTGPRPAAESVELPAAGLSEAVLRDLRAACPEVATDDAARLTHAAGKSTEDLLRLRAGVAADAPDAVARPATEDEVTGLLAVCGRHRVAVVPFGGGTSVVGGLTARRDGYTGVLALDLARLDGLRHLDPVSRTATFQAGIRAPRAEELLAAAGFTLGHFPQSFEYASLGGFAATRSSGQASAGYGRFDRMVVGLRVATPIGLLEAGRAPESAAGPDLRQLMLGSEGVFGVITEVTVRIHPAPAERHYEGWSFASFEAGTAAVRALAQDGPLPTVLRLSDETETAINAMTGGPRGDGCLAVIGVEGETRDVARRRTELERRLTELGGTPLGAAPGEAWRAGRFRAPYLRDALLDAGAVAETLETAAFWDRLPQTYAAVRDALIDTLAEAGTPPIVLCHISHVYDSGASLYFTVVAAQATDPVAQWRAAKTAASEAVAASGATITHHHAVGRDHRPWYGREIGEVGAAALRGVKQAIDPAGILNPGILLP

SEQ ID NO: 15398 - protein, 293 aa, Actinoplanes utahensis
MSRDVFTAVVNPAAGAGTAAARITAVARALREAGATVHVAYTRSLQHATELAAAAAEHTVLAVGGDGIAGAVAAGLLDTGAELAVVPAGRGNDLARAVVPLPADPAAAAQALLRTPSGLVDVAEAGGRVVAGSVCTGIDAVANDLANRRLPRRPAAYQLAALLVMLRWRPVRYTLTVDGVTASFTGHTVVVANAPWYGGGLRVAPHARLDDGLLDVVTVGPLPRSRMIGALAALRHGRHLGLPGITTRTVREITVAANRPLPVYADGEFLGTGPVTIRVRPAALRLIGAGGAG

SEQ ID NO: 15399 - protein, 214 aa, Actinoplanes utahensis
MSATSMNGASVRYARWRHRDAAAHAHLGEGAFLDDVAGEASRAYRLGARFVSIADPIALGPEPSAEHTLAALSFVRELTSHGMDVAWHAQLSADSAPWWVFSHLFPPATLDGPHAAETLAAWRAKYHLGRCFLRRGPGFVQIRDRRHQGFRRLTVSDPDHLAAIDALLAGRGREAVPERIVALFERQHLVVPVCGDVWWAPYRLQRWPLPSWEV

SEQ ID NO: 15400 - protein, 637 aa, Actinoplanes utahensis
MHVVLVSVPWSPIEMPSLALGLLKSLTLREFPGARVDVVYGNLEFVDWVTERRAFRYDDYKYYDRESCYLGHGDWVFSSALYTDPSWRVPEFVEAFAPDDVPGFDRARLATTLWLHEHAGEFIDHLAARIAADAPDVVGFTTTFQTVTASLAVARRLKELSPRTVTVFGGANCEDTQGEAMHRNFGFVDFVVRGEGELAFPDLLRSVRGEGPPIAEIGGLCWRDDSGTPVFNRPGRKPLATDAMVLPHYDEYFERFGASQARRWVEPRLVIEGARGCWWGERHHCTFCGLNGASMTFRSKRPSKFFEDIVTLAERHRVLDLLVVDNILDMAYLDSLLPRLTAAGIDLRMMYEIKANLRYDQLKVLADAGVVCVQPGVESLNTNVLKLMDKGVTGCQNVRMLRDAESLGLTVIWNYLYGFPGETDDDYLPVIEQFPRLHHLCPAGADDRLGIQRFSPYFEKPELGFADRRPARQYELCYDLPQADLFDLAYLFEAPQRGIGDDLAARLSAGLDTWRGEHWRSQLSYFADDDGITIANTRPGFDWRTVRLGTPVERSLFDLLDQPRTAAFLHREVGRRTGATVAEIDAVLERWDGLGLYFSDAGRMIHVVTQDQNQRLLRILAGRQWRAADRPPAPVAV

SEQ ID NO: 15401 - protein, 352 aa, Actinoplanes utahensis
MHVFVTIPMSDGAPGRVHGFLTDLFASARPWPGEYWFVRTWEQTSGADCFQVSLASAHLGAGEAADRVRRVAAAHDLRPDVVEAPVEEVPSPLWNAGLGGPGFGAVARRLYRAAAPLLVQLLPALGGDPADRYRIAVRLMLANAGATLLESEQRDLPSRGYAELLSLRLLSYRSHYEGVYARATDPDSFERRYAAHYERLGGYTRDLVRSCAVSGPSSDDPVTGGWVAMVRRHFSPVRDEFRAGRVVNAGLSIEDLNAGRAVPLPPTRFHTYLSAELEHLLHRDPDFLAFRLATSLLYSCLHTLGFSLVERYLFCYLLARANEDVSGRETADLQRELGALARQLVCTSPVTP

SEQ ID NO: 15402 - protein, 52 aa, Actinoplanes utahensis
MENIDEELDLNALEISDLIEDSGTEDETLSQIMAASCTTSGCACSSSSSSSS

SEQ ID NO: 15403 - protein, 304 aa, Actinoplanes utahensis
MSSTETDRWRALHVYLPHSVQTRFLREVVDPLLRDAGLRDRFFFLRYWQGGPHLRLRVRGTSAAAVESIGRALASAVPAGTPELAAEYAYEVSLQAHLAEREGEQPAPERSAGTVEEAEYRPEYGKYGGPAGVRIAERLFGRTSAAVLDLIAARADPAPRAPTGDAIRIMAMSLRGSGLDAEQSRAFLERYEQWWRPYLPPGADRSWPGMYERTRDRIRHLCEAVWHGHATDTFHDTYAEALAAAREVGGPHGDLAELTLGTASYARCIAHYLHTTNNRLGIIPAGEAFLAYVMCRSLTELEPV

SEQ ID NO: 15404 - protein, 889 aa, Actinoplanes utahensis
MTVRSPEILQRSTRASATLSPYVVFRRARLPVAELAALGLDRYWARVDGWRRRAAAGARVAAEVADRLAALVPGADQTVRAEIVRLRRDVYNGRSDPARRRLTLTEPHLGAAAGQVRAWLELADEVRREERDLRTLFDAELAAARAGIRALFEHDAMAKGIQLSGDQLYESLQRYVRDDGPALKPSRLRTAESSLVNFAYRAALKPSPFGRFTEVGAFPPDLPPEAGGAPGTQSSTTLNRVLLNWMVGGWQRLPGGDDLGRMLLNSSLSIDEKSIRFIGLRPDGRATGYGGTEQVVRLRRDPVVDRVLGVLAGGSAPVPQLRQALAEVAGGDEAARKVLRALLRTGLLSFRPGIDEQDPAYAAKLADLLNSAPAGPLSVLAADLRTLRRLETDFPDASVAGRRALLAVGNRAIAEVGAVCGVGAPPEAIVRAPVYEDAWTRARPATWNADAIAAARPALASLWRFASMLDYGQVKRLGLYSFAVDRFGDRETVPFLDFFDQLVRLPEAEQDAVFAGHGSALARAYARRRDAALHELGDRIVPDGDGVLRLSPEAVDDACARVEDRVDPASITFRVQFARRADRQPAVVVNGVLTGYGVYFSRFCRFIDGSAMPGWTLRSALRDHLRDAFGGQVDLNAVLGFNFNLHPPLTDRVLDYPGSWPSATAQRRYGLGDLAIRVDHGSHRLLLWDPAAGAPLDLMPMNFLIPVGVPVLYQLLEALSPTTRYPWHPLDDIRRVRDPGGAGRLVVGDVVADRRSWTVPARDIPMLAEVSRDSYPALLRFDEWRRSRGLPRDAFVLCQTPDEYAVLSGRTRGLPRSWSDFEHLHRASVHKPMYVDFRNPLSVRSLAKSALTRDDVHLSIRECLPATDEYGRGDGPAAAEEFFVELYRD

SEQ ID NO: 15405 - protein, 608 aa, Actinoplanes utahensis
MTTLLDDPLAALAGDAPPPTEVLLGPLTGPARLSGPDGGHRPGRGLAVLFWRGRIHVLAYRPGAGGCPTCLAWFLTGPQAPPPAGAPADAARADLLWQRLGPALRVVVGRLAARLLRDGTASGTLATVDAATGTVQPGRVPPSSACPACAPEPADTTVAFGSRPDLLDKADGTLRSRRPLPPDLTSDYVGAHSVFREPRVDLDGPVPAAQVGLPLRDGGREPGIGRCLSFARSRRTAVLEGLERYTGFHRQPTGRAVEASLAELDAQGLDPRTLGYHDDSRYAEPDFPFAPLGRHERLRWVPVTPLGGGVPRYLPEPALSWAHRPGSRRPFFYDTSNGFALGQSYEEAALHGLLEIAERDAFLLTWYHRLLLPELTLGPADRGIRQLVDRVAVVTGFRLRLYWAAVDTGIPVVLALARRDAAAGPCTFVSAGANLHPRAAAESAIFEVAAILSAVTHTFDRDRAHGRRLAADFGLVRTMADHSLLGALPQSRPWFDFLTTPERPELALADAVAAHPVAARLDADLDHVRARLQAAGLSAYAADMTTPELRWRGLVCTRVFVPGCLPMTFGHHTRRMAGLPRLARQVTPYQSGLAPGQSPADVPPHPFP

SEQ ID NO: 15406 - protein, 535 aa, Actinoplanes utahensis
MSPASATATGFVLARPDVAVRRRAGGVWVGVGSASFTVRGAAAADLVTALLDRADGTRTASELLQDLPPAAARLLEVLTARDCAVLLDAPMSRYADEPAPPWLILYFAQLTRHPERALRRMRDTVPVLYGRPSWLARLRHVLDGVPADYRSLSENPADGAALPVVDADGLPHGQVVRIQDALRAAGRPHGIAGSVGSRYWLVWSDGDAAGCWDCLRRHLGAASAGTSVDEWTAAGVVAHSICRRAAGLGTVANAALSLDPDRPEVRAHPAVIEAGCRCRRARRRPAAEAPDPVVRRDLVDPHDGTDRHGEHDRIVAALAGWTDPVAGPFLDLDGGELPQVPYGRARATVLLDGGGRRPVHAAALSSREALYQAALNAVEVLAGPPARNRGAGWTLDEAIYRALLRSSARHPAGAAAELPDDLGPQPCVRVSRYLERSAGLGPIGWTGERLPNGLYRVAGRPASGPALHGLGACYAEAVATALLGRVNDDGVLVPVNPHFRRWRDAWQQLTRPDVTEPDRAPVRFTQGRLRVVELA

SEQ ID NO: 15407 - protein, 232 aa, Actinoplanes utahensis
MRSDLSTMRPLLAGFATRTSTSDGRAADRRPAPFPDAAPVAVDLDELLAEPHADLRDTLLARRSSLRYADEPVRTELVIALLHAALRRDRLDWRLDDAAGPVEAFVFAVRSRGLPAGVYRVTAHDCSFLAPVEALGDVEDLGVQREFAGAGGIVAMYASLDRADSWAGPHGYRMSVVRAAAALYDFHLGCQSYGLTGTLFGGFIAAAVRRLVRGDGVTRHPLLSATYAHPEG

SEQ ID NO: 15408 - protein, 539 aa, Actinoplanes utahensis
MVVEVNAETIGRAARRDMQIAVPVRPAVRRGVRLRRSGDTVVLDGADRPQAFTGRFARDHLTQLVAACDGTLGHRDLAARTGLDEGTVYKSLALLWAAGAVEEGDPPGALPAAAPEFACLLSRLGNSTGANRSWTGAARRLARTVVHLAGDPSLVATAARCLDGAGRPVTGELRPAAAGEDGLSVFFETRGSAPDLAALRRRCWTEGRPLLRVRVGATAVTVGPYVDPAFTPCLECGTAAEGAPDGDPPAGTGDLVAGLVTHHVTALVGRATMTHLPLDAAEVDLSTLATRYRAAVTRPGCPTCSFAAGVRAAEPPAAARYEAAVAIPPRRFLDPKGHLAHYQSANIALSSQFRTWPTCPRRPLPAADLTRLAGEPAGGTGRRPGPREVALLLAVAFGVREQSPVDGAVRRWTAAAGNIGSATAYLLCRDDTVLPAGAYAYVEQEHALAGMASGTPPPGNRPLLLVITANLRKVVRKYGTFGLRLALLDAGCAVAAARAVAGHLGLAYDLARDFDDDVLAECLGLLPSDEPVAAVLELG

SEQ ID NO: 15409 - protein, 203 aa, Actinoplanes utahensis
MTSDRPEDDVYLVRDAFGTGYAEAYGIRAAIPVTGSVLPDDARLSTARIIVALHAGRDDDLRDALDRAGFDRGVPTVGVELLPTRIVCGPAVIPGATACHACYRRRIEQHRDPGRPYDLSAATRDLPEGFGRPHLAVTHGLLGLALAEMRGGPVGLGGTVRTFDLVAGTLSSASTVAVDRCRRCGARFRDGAPAGAGAVAGLP

SEQ ID NO: 15410 - protein, 448 aa, Actinoplanes utahensis
MSRGIVAEPCGPELRRLAFLISPFGLVSRTVSLPPADADPPFAVHVAGIGDPARVLDGMRGWSDAGDMGNINGVGSALTGERARLTSVAEALERYSICSWHDDEMIFAAEDALTEECVSPARWPRCSAAEFRREDCGLRPYDPGVPIRWVRAWSLTRRRAVLVPAAAVYLHLAPRTAAELFTRGVTTGAAVHSDIRRAVLGGLLEVVERDALTLAWLHRLPLPELAVDPGLLDPAARAARAAGTAGHLEVRLFDATTDFGIPVVYAVQLAEHEDALAQIVCATCDLDPGQAVGKVYRELAALRLALRDHVTRRPIRRPDDGTVNVLGSAAYNAAAARRDAFRHLLAGERTVRRLPDLPGLPAGADPLTTAVDRVAARGAEVLAVDLTTDEARQAGMYAVKVLVPEAVPLSFIHSERYLGTPRLYAAPEAMGHGRRDEQSVNPDPQPFA

SEQ ID NO: 15411 - protein, 367 aa, Actinoplanes utahensis
MACSSPSPEAICGSPPPPRRAARRHYRFALMAGTLTRMTRRLINPRRWTPPTLNDPGPTAPLRVDRLLPTDGHGPEDVQFDHTGQLLTGTADGRILRIDPDTGEHTVLANTGGRPLGLHPMPDGGVLVCDHDKGLLAVRPDGTTTVLCDTVDGVPLTFASNVVQAADGTVWFTTSTSRWPLDDHLGDIMEHTSTGRLVRRDPDGTLTTLIPDLKFGNGLVLAPDESHLLIAETAGYRIRRHHLTGPHAGRTEILVENLPGFPDNMSLGSDGLLWVAIAAPRNPLVDRLLPLPGFLRLLVWNLPEAVRPKATPIAWVMAFTLAGDLVHDLRTDDGSYGFVTSVAEHHGTLALGSLTENDIALLHLPSL

SEQ ID NO: 15412 - protein, 136 aa, Actinoplanes utahensis
MADGTRAAATGAGRLATEAGKGADGGAAATRGAGRLHSDGTQKLTDSIVAGSATPAEVSALFTAMDRRAAQALPYGAPEGATGSAMWQFRMDGTAASDPAGASTGDGTRITVAVGLLVACVLVTGLVRRWKDGADA

SEQ ID NO: 15413 - protein, 605 aa, Actinoplanes utahensis
MTSWTPRRAGAVTTTLVLTGLPLPVVPARAAEPDALQVTDQETVTVRLDASGVPVGATLVDVLAAHGSGTAVLRNPSATAGLRNLVGYGRPDTSGDRLVQRVTAGDRLATASTVTGAVPITLHAHYELDGATISPAALRGRSGHLKITYTVTNRTAEPTAITYRDAGKTSHTVTEKVFLPLVGDLVADLPSRYRDVSAEGGTVAGTATGGSHVAYNLVLAPPMGNPQATVTLSAAVTDAEIPDVTMQLIPATTGTDPASRFAGQTFTSTTGANTHLADAAGSVDDQVVSLRAGVAGLADGLTQLATGADALQRQLTGQLVPGADATAAGAARTSTGARRLAEGTGKVASSADALSAGTRQLSAGLTELDTALSRLSGAAGMSASLQAAQALQTAVEQIAAQLGSADDPDTVLGALHTLGAGAARLHGTLSSAAGDATTIAAGIATGAGTASSLSTAASGTATLVSGIVDADCGPNGPLPAADCADLRRAAHQCTGSAAGMHALSGELSKAATGLRALGSGLGQAEDAAAVLSDGISTTAAGLQRLTLALSGPAGGDTAKGVAQGLDALVAGLAQQVHGITALASATGRTTGVAGQVNQGAAQLAA

SEQ ID NO: 15414 - protein, 922 aa, Actinoplanes utahensis
MSNLLYRLGRFCARHGRWVTVAWVVVAVAVIVVGHRLGGGSTDAVAVGGSDSAVAQTLLDREFPGRSADASPIVLKARSGGVTDPAYADALRDTVQRIRRIPGVGQVSDPPAAGDAALSPDGHIGYLTVTPESDSASTLDLAERVRDATGPATGAGLDVAVGGQLGQQLSKSPVHTSELIGIVVAVVVMLLAFGSAVAMGVPIVTAVLSVGGGLALLQLLGNAAGIPTVAATLATMIGLGVGIDYGLFLVVRFRRLLAGGLTAEEAAGRTAGTSGGAIVFAAGTVVIAVCGLALSGVAFVGWLGYSAAIVVAVSLGSAVTLTPALLGWLGPGVNRLSLPGRRRGAAVTGPEDLAGTAWARLAVRVAGRPLTTTLAATAVLLTLAAPVLALRLGQMDAGRLPAATESRRSYDTLAEGFGPGANGPLRVVVEMFAPATAPDGASTTDGQDPRARDDRLVALRAALAQSPGVRTVSDPVISADSAVAVFGVTEQTSPSDERTVELVHRLRDTTLPRALAGRGAEGHVGGLTATKADLAGRISQRLPVLIGAVLAFAGLLVLLAFRSLWLAAKAAAMNLLSIAAAYGVVVAVFQWGWGVGLLGLDGPVPIESYVPMMMFAILFGLSMDYEVFLLSSIQEHWHATRDNARAVSLGLADTGRIVSSAALIMVAVFASFLINANPVVKMFGLGLSVAVAVDATVVRCLLVPGVMVLIGERQWRLPPLLDRLLPGIAIEADPAFFDSPPVAPARNGHDVAIGGGRWSTAAVAVPLIVLIIVVTVHRGSVAAATPAVVALLLGAFVAGRRQRAGVGARGAGLLIGAATSTLAFAGAAVGLPQLPSAAGLTIALTVLLAAVPPLLSRGRIPPAATLAATVAGTVGWAAGEPEATVLLCTAAGFTVSLLGRLLGTGLRRRQLSPDPSTIGADR

SEQ ID NO: 15415 - protein, 494 aa, Actinoplanes utahensis
MRGLAARRGSGAWQGLRGRLLAGTLALLAAGLLVADASAYAALRTFLGDRVDVTLRSLASRIDEQAGRGTGAAISWETVRVLAPGTQYVAVLDPDGRLLVAHAAVSGSEDLTPPVLPTPIPATSEPFTAPSAGAGPGYRLAAITLPGAPPRITLTIGGVRVHPAALIVGVSLADVDATLHRLLLVEVIASTAILVAGVAVATLVLGFGLRPLRTVADTARAIAGGQRERRIPVPHPHSEIGRVAAELNAAFSEREEAEARIRRFVADASHELRTPLTTVRGWSDLYLNGGVSQWEQADLAFARIGAETGRMQRLVEDLILLARLDARRPLDRAPVDVGAVLGGLVADLSVVEPERSVSLRVPPGPAIALGDEASLVQVFRNLLGNAVRHTPADSPIEVVVDGVDDDLVISVRDHGPGLDPQLLARAFERFWRADGGRAAGGGSGLGLSIAREIVEQHAGTLTLHDRGDDGGGLEARITLPASPQRTVRVSDGTR

SEQ ID NO: 15416 - protein, 518 aa, Actinoplanes utahensis
MAGGQAVDHGRHVAGSVHHRDLDLLVVPFVVQPGQRVQQALIPVAEHRLVEARVAIGHRLVLRTGQVVHLHLPGPDHPGATDHPDHEHGRQHQPEQHPVQDRYPPPAVGELVRGDVRFDHRPAQGPVVDVLLDQSGPPVEPQNGVAHGERTGEQRRTAPAPDALRHDHVSLRQPPGDRGVEPRLRHVNHRIDHELHRCAAAAQPDDGRANAQIGEFDDLHGHLPALRVTTAGNPRCPRAGAFSQSAGSRQAAGRSSAAPVRHRGTVTTPNPADPRQAGGLRPRTAGLVALRPARVLVVDDEAPIAEVLTAMLSFAGFEVRAAASCAQARALAAEFRPELAVLDIMLPDGSGLDLCLELRARDEQLAVLLLSARDSIEDRVAGLTLGADDYVIKPFSTAEVVARLNVLLRRTAGAAPTTARRVGDLELDEQTHRVVRAGRVITLSPTEFRLLRYLMRHVELVLSRRQILREVWGYEWGGDAAVVEKFISQLRGKIDADGAVPLLHTVRGFGYAIREPVA

SEQ ID NO: 15417 - protein, 380 aa, Actinoplanes utahensis
MNVRWWRALAAASVGVLLTTVGGHGASAAPPTPLQRGLDDLHRLGVAGAQGLIRDGSRVTAARSGVADRDTGAPMPADGYFRIGSDTKTFVSVVLLQLVGEGRITLDDPIENWLPGVVDGHGNDGRHITVRQILQQTSGLYDGTGDLAVLKSADEYRAHRLDHHTEAQLVAAAMQHPPLFPAGTRWSYSNTNYLVAGMLVERVTGRCWFTEVRSRILAPLHLTRTFYPGDRSTLPRPHAEGYQHFTPGGPLIDVTIVNPTVAGSAGGLVSTTTDMARFWQAVTSGRLLPPAQMAEMRRTVPAGDFEALRPGITYGLGIMWVPNRCGGYWAHWGGMPGMEIMEAAAPGGHRSAVFYLTTDLTEAAPVMQRGMTLLDDLICD

SEQ ID NO: 15418 - protein, 127 aa, Actinoplanes utahensis
MSVLRTGLLATLAAMAATTVTAALARCAGVDFELPDGGQSIPLPGFAVMTGIFSTAGVLIAVALRRWSAVPAVRFVTITAVLTVLSLIAPVLSGGNPATVLALLALHLIAAAVMIPGLARSLSRPGG

SEQ ID NO: 15419 - protein, 262 aa, Actinoplanes utahensis
MAAAGDLRGPVDLPGWLYRIATNTCLDLLARTRPEPATGGEVLWLQPYPDRLLDDPETAAVDRETIELAYIVAVQHLAPRPRAVLILRDVLGWPARQVADLLGDSVNSVNSALQRARAGMREHLPAERRDWTGGAGDPGTRDLVRRFTEASVTPDIARLATLLRDDIRYSMPPTPGLVVGRGAVVEDWTASGFAGMTGLRAVPTAVNRQPAVAFYHWRAARQACLPLTLDVLRITGGAIAEIITFHRDRFPSLGLPEGLGAA

SEQ ID NO: 15420 - protein, 401 aa, Actinoplanes utahensis
MKKILIAAAGAVALAGAGIAVATQADAATLSSNWYASAPYLMPFDNSPPDPVEVMNATGQKAFQLAFILAPNGGGCTPTWDGTRPVADDTTATALISRIRGNGGDVSVSIGGYGGTKLGQTCGTPEATAAAYQQVITKYGLKAMDFDLEEPEYENTAAVHNEIGAARILQNNNPGLYVSITTAGTAAGTGWFGTQMLNEAKAQGFTPANYSIMPFDGGFSGGSAQVSALEAFHTLLMNTFGWDSATAYAHEGISQMNGRSDAGEYFRQADFQTTLDYALNHKLARYTNWSVNRDRQCADPNQSTTSGTCSSVPQTPWEFTKYSARFAGATPPVTTSPSTTTGTPPTGGTCTVAAWSATATYTQGNQVSQNGHKYTAKWWTQNESPATHSGQWDVWADNGTC

SEQ ID NO: 15421 - protein, 422 aa, Actinoplanes utahensis
MNRKRLCAAALATAAGVAAAMTVVHAADAAATPLPAHVFAPYFEAWTGDNPATLVQQSGAKHLTMAFLQAATKGSCTAYWNGDTGSPVAASTFGADIAAIRAGGGDVIPSFGGYTADNTGTEIADSCTTVSSIAAVFENVITTYDVTRLDLDIEDNSLTNTAGIDRRNKAIKLVEDWAAAQGRTVQFSYTLPTTTSGLADSGLAVLRNAMANNARIDLVNLMTFDYYDGATHQMAADTKTAATGLHDQLHQLYPAKTDAQLWNAVGVTEMIGIDDYGAAETFTTADAPVVAQWATQKGLGLLSFWALQRDNGGCPGTAGSDSCSGISQTTWQFSHAFAAFTSGGGTTSSPGPSASVSTSPSSSRSTPPAGCTAPAWNASSVYTGGSVVSFNGHKYRAKWWTQGESPATHSGQWDVWADQGTC

SEQ ID NO: 15422 - protein, 106 aa, Actinoplanes utahensis
MARSEELFGDDDYPAYTMGRAAEIVGATQDFLRRLDEEKLFTPIRSPGGHRRYSRYQLRLAVRAREMVDAGTALEAACRIIILEDQLAEALEINRRLQPDSPAEAP

SEQ ID NO: 15423 - protein, 198 aa, Actinoplanes utahensis
MAVAEQPGVLRNRLLEKLAGRARQHDGPHAAEQERTHSWWRVRHSHEVIVTLLLVALAGAAIAVVLVWVYLGLNVVVIGGAPRRVATHPQVVTGWATAVTVAHGSPPAMTGIALLIFPKPALGRSGFETGVAVMPHIEGPRPPDPQRPAAADHRRNRERGRELRPLPDLARGLNAGPVHHLLGCERMAEPKHRLLSAV

SEQ ID NO: 15424 - protein, 67 aa, Actinoplanes utahensis
MATGTVKWFNGDKGFGFISQDEGGPDVFAHFSAISANGFRSLDENQRVEFDITQGQKGPQAGNIRVI

SEQ ID NO: 15425 - protein, 142 aa, Actinoplanes utahensis
MIRSRRRSLGRWTAEIIRVRAVPGRWSSGSWGRPEIQRSGPVLLRGGYLCWKGASHRATASTRPGVLADVPSGRRMTLVGVAPGAPAATARRLADLGFTPGTTVEVVRRAPLRDPVIYRVRDYDVCLRREQAALLLVAECAA

SEQ ID NO: 15426 - protein, 295 aa, Actinoplanes utahensis
MSVLPILVLLSGLVACGVLLTLLMRRGPRQPAAAPGDIPRAIARRTAVLRWTGVTLGVIVGVVAARSGDLGTGLLMAAPLFGLCTLIGVLAGELTIRPPHGPTRTAAVEVRRIRDYLPRHLSRVVAAAGGGLLVLLTATTAAGGPDDMGRPGRSLTRQCTSDTVESHGPWPGLFYTWPLLVVVLVGLLMGYLAVRTIVRRPRSGSTGDLAVDDALRRRAARVVTGAVGVLIAIPLAGVSLIAAGGLLDISCAPTWWTITGWALLAVVPASLAMVTWCAVALVTPLDRADPLVGAR

SEQ ID NO: 15427 - protein, 45 aa, Actinoplanes utahensis
MDGVKIDELDPDASAGQRPDEPAQVVQVAGRRSMECAKTVSSSRT

SEQ ID NO: 15428 - protein, 679 aa, Actinoplanes utahensis
MVREHGDVQPGAQAAGDSGVTVSHAQGQQVGDRNVQHNHFPAAAVSPMSVRPSSVPAPDGLVNVAVAAGVFVGRGTQLQQLDEVLAEPGAAVVQAVHGLGGVGKSTLAARWAWQHRDRYRPVWWIDADTTAGIDAGLATLATALQTDLPDGLSLEVLRERALQWLASHDGWLLVLDNVNDPGDVARLLARVGTGRLLVTSRRATGWAGIATAIALDVLDLDDAAEAMRQVLAGSGRAGDADGLERVCRELGCLPLAVDQAAAYLAETGLSAAAYLQLLQQYPAQMFDQGGEGAGGRTIARVWRVTLDQLSDTPLAGDILRILAWYAPDAVPRTLLDGLADPATTARAVGRLAAYSMITADEDTVSVHRLVQAVARIPDPDDPHRQPHDISTARTRAIEHLQTAIPDDWRTPQDWPVWRVMTPHIEALAQHDRNHPEPDAAASRLYNQTANFLHDQGVIGRAIPLYEQASADCRRVVGDDHLQTLTLVNNLAGAYETAGDLGRAMPLYEQAVAGCRRVLGDDHPDTLTSMNNLAGAYQAAGDLGRAIPLFEQVLADRRRVLGDDHPDTLGSVNNLAYAYHTAGDLGRAIPLFEQAFADRRRLLGDDHPQTLTLVNNLAGAYRTAGDLGRAIPLYEQALADRRRVLGDDHPQTLGSVNNLAYAYQAAGDLGRAMPLFEQAV

SEQ ID NO: 15429 - protein, 261 aa, Actinoplanes utahensis
MGPGLIAAPACRLCPMPVLDAHESTATGSRLPSVRALVEERIIFNYRLPADHLERLLPVAWLTPQLVDGDAVASVCVLRLSKVTAGPVPSLFGVRSVSAARRYGVLDQRSGGRPAVFVTERTTDSALGSLFTGAGFSAQHEHLSANISRDGESVLVALGNDRFNGRAVPAQRWSSSLFPALGDFSAFLAEGIRSYGTSRHEGQLTILDLFKEDKGYEPLAAREVRGSLVQPWLDAGAVLDSVARTTNAKYRWTYHGLTPKP

SEQ ID NO: 15430 - protein, 218 aa, Actinoplanes utahensis
MDRLLVPLTPVIALLLWGVISPRSQWQKLFAWGYRNPEANEPSDAAYMLTRIGNVVMLGVLAWAVLGLPLPGGHAGARPAATPQRPAVEDLYEAFGVDEATAVMPPVVTGSPKSTRPVKVVRYQKVDATRPPVYLGQALTGKTGDWLILGVRADTPPTGVRINEQVPFDLYVGVLTGCTVSCPTTPISSGKKFYLVPVRLSRPLGSRLVYDVTGELVP

SEQ ID NO: 15431 - protein, 42 aa, Actinoplanes utahensis
MISTTANPNRSGRLRNPAHPAYRRGDQFPAGRVEIGRRRLTL

SEQ ID NO: 15432 - protein, 1092 aa, Actinoplanes utahensis
MLKPARVSVLLTVLLALVATPGTALAAPRPPRVHGQSVQAGHLRVQVLSPTLLRLEYAADDHFEDQATFNAVDRAPGRTWFRAGTAHGELRVWTGAVTLHYRLDSGPVTAANTTLDLTVAGRRTSVHPGFGMQPADPLGGWYRGLDYYAGQAGPVDQLSLHPGLLDRQGWYLLDDTATALRTGNGQLGARPARTGAYQDGYLFGYGHDYPRALADLRTLTGPSVLPPEWAFGTWFSKYQAYSTADYRTTILPAFKNHRVPLDSLVMDTDWKAPNQWAGWNWNPGLFPDPDAFLKQLRAAGVNATLNVHAAISGDDPRFAQAQATAKGRLQPSTNSFAPNPYRFDWGDPDQAAAFVQLHQPFEQQGVRQWWLDYCCDDSTVSTPGVTPDSWVNELYRREGDARGVRGFALSRIGAAFPAYTAIGPSGPWAEHRSTVHFTGDTEATFATLAFAAAMTPGEGAAIGQSYVSHDIGSFAGRHLSDDLYLRWVQLGAFQPILRLHSDHGDRLPWEYDSAVSGPAADFLRLRESLVPYLYTAARQNYDTGLPMARALYLNWPEQSEAYRHDSEYLLGDSLLVAPVTTPGLSTTAPVWFPPGTWTDLFTGETFRGPVTRTVGATPDHMPVYVRGGGILAQRAGDVNVATQPRDRLTLTAYPHGSGTASVYEDNGDGLGYRTGRSARIPARYTEGRRAALTVGPVQGTYPGAPTTRQYTVAFADVARPHRVTADGHSAAWTYDPGKHLLTVALPAIAAGRAVTVEHDGATLTVAQKPAVDTTFTAPDGLQSGATSTLVATATNHGPGAITDVAATVTAPAGWVVTPKSATTAARLAPGATFTATYAATPAGAAPRTQPVTVHIAYRNPDGTATSAPAALTVPLKPVAVTFRVLAPPGTPPDATLYVPGSIAQLGPWDPGKQAMTDRGGGVWEATVSILDGTDLQYKYTRGTWDRVEEWGSITGTDNRSVSVDGGLSHTMLVDDTSTAWGDASVPDSHKAIRYWRDPLVVTTEATARAVTVRFERDIRPTGADYSGSVTVAGPSGTVAGSVAEPSPGTLVFTPGAALPAGTYTGTVTGVTSAVSDGVPIQKPYTFTFAIAP

SEQ ID NO: 15433 - protein, 200 aa, Actinoplanes utahensis
MIVVVRSELYRSVSILSSWLALIGFALMAALVGWFSKEAWSLFAGLGAFGIAVTVTAQHYQHRTIVPVYLSHPHRWRVLIAQCVSAAVLGILLTAVSGLPVLLDGHAAQYRSTVLVAPVMAVFGTLCTAVLRHPMWLLGGVFAWLLFAEGLINRMAIGLPFASFAMASGGNVKALLYLLAWTGAAIPPAVWAIHRDVASD

SEQ ID NO: 15434 - protein, 290 aa, Actinoplanes utahensis
MIEIRDLTKTYGQVAAVRDVTFTAAPGRVTGLLGLNGSGKSTTLRILLGLARPTKGVALINGRRYRELDHPVRHVGAVIEQGLSHPGQSGYAHLRTQALLGGFPRERVGRLLEYVGLGHAATKRTGDYSLGMKQRLAVATALLGEPSVLVLDEPVNGLDPPGMAWLRELLTKHAADGGTVLISSHLLAELEHFVDDVVIIGQGRILASGTLAELAGTERLRVRGGDPARLAAYFEHYGATVTPDGPVLFVSGISAEQAGTIALAAGVPVFELVAEAQHLQEIFMSVSEAR

SEQ ID NO: 15435 - protein, 320 aa, Actinoplanes utahensis
MSGELVTKAIDLLCSNYIFADKARTAADGIRARLAAGEYDGLTEQALGERLTSELFAVCQDRHLRVRVRDESLHDALTEDEVEAAWREQDRLGNHGIARMERLDGNIGLLELRAVTAADLGGRAIAAAMELVSHTHALILDLRRNRGGSPDGAVFWCSYFFPDGETHLNDIYEGATGRTRQYWSHAWLPGERYVDRPVYLLTSGTTFSAGEEICYNLQAQKRAVLIGETTRGGAHPTEAFPITATFEITVPTARSINPVTEGNWEGTGVIPDVAVPAAEAFDVAYRTALRHVLTTSAPPAVLTEARAALERIPDGRDARA

SEQ ID NO: 15436 - protein, 250 aa, Actinoplanes utahensis
MGAKTALLAFTTGDLRPALREAVDADPAEALALVRGFHPDYDVTPIGDGVLGEDVYPPDDTSYATVLVGAELLCDRRLVGDRPSQLPARLLQAGAGRRIIMHGMHSVSDWLCFAVWENGSLVRSLSLSPDGGIVENIGEPYDFERPYWAGERPAGATFTGDPYPLPFHPLELGEDALRALFGFILEGLRDPSDVDPYEVPLRGFRVADPTGREQAEREATMERLLRQMGPPRRFRMKPDGTFEEIRDAEA

SEQ ID NO: 15437 - protein, 51 aa, Actinoplanes utahensis
MLTFGLILLLLGIFLHVSILYTIGIILLVVGAVLWILGAVGRPVGGRKVWF

SEQ ID NO: 15438 - protein, 257 aa, Actinoplanes utahensis
MGALSHVRGRGRREGRRHHPGTLATLPRVMIAAVDEWVFNERPAGVRFLTDRIDEPGRTRVEDEIWSWIVRGETDAADFVDCFDVEEDRHGATDEELAAAYGRALDARRAQQRAWGPVRTNLTSAFAELNELGVVARENFACCGTCAAAEIHDERDGSRHWRGYVWFHQQDTEALAESANGSVYLGYGTWAPENLDRAAYDDLSAAERQARYRADVEQMLDEIVFPVLHHHGMQVTWNRSLATRVHVTGARWYAALP

SEQ ID NO: 15439 - protein, 132 aa, Actinoplanes utahensis
MSRRPRPAAGGTPPGCTVTVCRGCCCGTPEVRAIDHAAQLARLRQSLAGAAQVRVSGCLDACEHANVIVVQPSPEGRRAGGRPVWLGLVNDPGATDDIIAWVHAGGPGLADPPGLLDLHLINPARRIRQQLT

SEQ ID NO: 15440 - protein, 657 aa, Actinoplanes utahensis
MTPSTAAPHPAAGAPKRRLVSRMGALPEIRWATLATLLFAAGGITQLAGAPTPLWWVLYLACYAAGGWEPALAGLQALRERTLDVDLLMIVAAIGAAAIGQVFDGALLIVIFATSGALEAFATARTADSVRALLDLAPERATRVDADGTEHSVPTGELQVDHVIRIRPGERIGADARVIDGASEVDQATITGEPLPVAKTGGDEVFAGTLNGTGTLLARVDKAAGESVIARIVALVEEASASKAETQLFIEKVERRYSLGVVVATLALFAVPLLSGADPRTTLLRAMTFMIVASPCAVVLATMPPLLSSIALAGRHGVLVKSAVVMERLADTGMVAFDKTGTLTAGTPGVAEIHPAGPFTERDLLRLAAAAEHASEHPVAAAVVSAARERGLVRPVAEDFASAPGRGVRALVDGRLVQVGSPVLLDTVTAHRDEVAEVRATTARAQDAGRTAVIVLVDGRPAGVIGLADRIRPAATASVTALAQLTGARPVLLTGDNAGAAARLATEAGITEVHAGLLPADKVERVRTLQDGGRRVLLVGDGVNDAPALAAADLGVAMGGRGSDLALSTADAVLVRDDLTALPAVIALSRRARRLVVANLIIAASFITVLVCWDLFGHLPLPLGVAGHEGSTVIVGLNGLRLLSARAWRHATKGAAA

SEQ ID NO: 15441 - protein, 113 aa, Actinoplanes utahensis
MHTSLPDFRMPDDEQVHLAAEGFRLLADPTRIKILWALLQGESSVACLAEMVGAAPTAVSQHLAKLRLAGLVKGRREGTYVHYSAADGHVRALLAEALFHADHAGAGISDEHR

SEQ ID NO: 15442 - protein, 754 aa, Actinoplanes utahensis
MASVAGPLPVAPNRVELSIGGMTCASCAARIEKKLNRMDGVTATVNYATEKASVSYSGDVTADDLIATVHKTGYTAALPPPPAPAGADRAEPTQPADELHDARTRLWISLVLSVPVVLLAMVPAWQFTYWQWLSLTLAAPVVVYGGWPFHRAAWTNLRHGAATMDTLVSLGTVAAFGWSLWALFFGTAGTPGMTHPFALAIGRGDGTGAIYLEAAAGVTTFILAGRYFEARSKRRAGAALRALLELGAKDVTVLRDGVEHRIPVAELRVGDRFVARPGEKIATDGVVEDGTSAVDASMLTGESVPVEVRSGDSVVGATVNAGGRLIVRATRVGADTQLAQMAKLVEQAQTGKAPVQRLADRISGIFVPIVIALAAATLGWWVGTGSGWTAAFTAAVAVLIIACPCALGLATPTALLVGTGRGAQLGILIKGPQVLESTRAVDTVVLDKTGTVTTGRMTLVDVIPADGQDREELLRLAGALEAASEHPIAQAVARAAAERAPLAPVAGFTNLEGLGVRGTVEDRDLLIGRLRLLHEHDYAVPADVEQAVTAAQQAGRTAVVAGWDGQARGVLAVADVVKPTSRDAIAALRRLGLTPVLLTGDNETVARAVAAEVGIDQVIAEVLPADKVEVVKRLQDRGKVVAMAGDGVNDAAALAQADLGLAMGTGTDVAIEASDLTLVRGDLTAAVDAIRLSRRTLRIIKSNLFWAFAYNVAALPLAAAGLLNPMIAGAAMAFSSVFVVANSLRLRRFTTISR

SEQ ID NO: 15443 - protein, 316 aa, Actinoplanes utahensis
MNTAVKLAGFGIGLAAVFTAALGLGRIAGHTPASAPAAHGHAAATAAHGHDGTAAEPVAALPGGLQVTQDGYRLTPLTTVLSTGVPRQFRFQIIGPDGRPVIGYTTSHDRDLHLIVVRRDLSGFQHVHPRLADDGTWSIPVAVPTAGQYRVFADFQPIGHDGITLGADVPAAGDYRPVPLPAAARTATVDGYTVTLAGDLAPGASSRLALSVSRDGRPVTDLQPYLGAYGHLVALRAGDLAYLHVHPDGEPGDGRTAAGPEVVFHAEVPSAGTYRLYLDFQHSGTVHTAEFTAVAGPPVSAPSSPAGHGADGHNHD

SEQ ID NO: 15444 - protein, 68 aa, Actinoplanes utahensis
MATETYTVTGMTCSHCVNSVSAEIGRLPGVTAVQVDLASGAVTVTSDGSLDEAAVAAAVDEAGYRLAR

SEQ ID NO: 15445 - protein, 35 aa, Actinoplanes utahensis
MSLDTPLAFAASTLPALLSTALFDLVVALERWLVP

SEQ ID NO: 15446 - protein, 333 aa, Actinoplanes utahensis
MRITVLGAGSWGTTVASVLTRRDHESLIWARNPDTADEINVKHTNDRYLQGFRLPARLRATADLAEAAAHAELLVVGVPTGAFRATLESVRPSLHPWIPVVSLSKGLERDSLLRMTEVVKQVLPGHPAAALTGPNLAKEIMSGMAAATVIATEDLTVAAEIQRVFRRGLLRVYTNHDVIGCEVGGALKNVVAIATGIAQGLGVGDNTRAGVISRGLAELTTLAVAMGGEATTLAGLAGMGDLVATCISPHSRNRHVGEQLGRGRGLDDILAEMGQVAEGVKTVHAAVRLADRHGLPMPITRTIHRVVTGEITAERAYAGLLRSHPAGHESEPG

SEQ ID NO: 15447 - protein, 347 aa, Actinoplanes utahensis
MSKRTATGLLGAALTLLLSACSAAMVPVAPADSSGLGRQSVHVGIAYDSAGRGDKSFNDAAAAGVDRAKQELLVEASEAKTQAESDDARAAALRGLAAGGSNPVIAVGFLYAAAVGKVAKEFPGTLFAIIDDDSVTADNVVALLFSEEQGSYLVGVAAGLATKRHRVGFVGGVDVPLIHKFAAGYVAGVHSVSPDVQVDVRYLTKPPDFGGFSAPAKGKAAAQQMIAGGADVIYAAAGGSGTGVFEAATAAPGHVWTIGVDSDQYATAAEAVRPHILTSMLKRVDNGVFQEIQAFVKGDRAGGRKRYDLKVDGVGYATSNKALGPYVPGMEKARYRILSGAVRVPVS

SEQ ID NO: 15448 - protein, 535 aa, Actinoplanes utahensis
MRRFSIGARLFGAFAVVLALLFAVAVVAYATIVAQRDAATQVRRLELLTRQAGEIKTHATTLNGWQAGFINDIYRLGAGRALGGDSVAYKAWQQERDAFRGFLAQVDTASMTEAERDVFNRLTTELATYVDINDKVVAAYRPGTPKALWNADQIALYDSWNSYYRIMVSAQRLAASVDDRSVAAVRSSADDARRAELVILIATGLALALGALSAVVVTRSIVRPVGSARDALRRMADRDLTVEPPADSGRDEVAQMSAALGEAVVAVRTIVSDVARQAEILTHTSAELDAVSGAFAKSVGDTSEQAGLVAGAAEDVNRNVDTMAAGSQQMGASIEEISRNAAEAASVAAEAVAAAHSANRTVANLGTSSSAIGDAVKLITSIAAQTNLLALNATIEAARAGDMGKGFAVVAGEVKDLAQESARAADEIDALVQAIQSDTGAAVTAIEMIGEVVGRISDYQTGIAGAVEEQTATTGEMNRGAVAAAGGTATIAENIRAVAAASAATSAEVARSREAAAELSRMSAQLRDAVAQFRY

SEQ ID NO: 15449 - protein, 264 aa, Actinoplanes utahensis
MTVIAETATHVDAAASTDPASELITAMAALPAGHPSRPGLRDRAIEAWLPLARHLANRYANRGEPRDDLHQVAVVGLIKAVDRFEADRGVDFAGFAIPTIAGELKRYFRDKTWSVRVPRRLQELRLAITTANNTLSHTLGRSATVADIAEHLGITEDEVIEGLEGARAYNSTSLSTPVSENGSELGDTLGGMDAGFEEAELRIALGPAMAALDEREQKIVSLRFYGNLTQSQIAEQIGISQMHVSRLLTKALAKLRSRLDGAII

SEQ ID NO: 15450 - protein, 1135 aa, Actinoplanes utahensis
MKGVSGTWKDLTESVNVMGDNLTAQVRSIAEVTTAVARGDLTQKIRVDARGEILELKETINTMVDQLSAFADEVTRVAREVGTEGRLGGQARVLNVGGTWKDLTDNVNVMASNLTNQVRSIALVATAVAQGDLSKKITVEAKGEVAVLAQTINTMVDTLGAFADEVTRVAREVGTEGQLGGQARVPNVAGTWKDLTDNVNSMANNLTGQVRNIAQVTTAVAQGDLTKKIDVDARGEILELKTTINTMVDQLSSFAAEVTRVAREVGSEGRLGGQAEVEGVSGTWKRLTENVNELAGNLTRQVRAIAEVTSAVATGDLTRSITVDASGEVAELKDNINFMVESLRETTRANQEQDWLKTNLARISSLMQGHRDLEVVASLVMNELVPLVDAQLGTFLLVDDGTAGAELRVVGSYGHVGAGLRFAFGESLVGQAALAKRRIVVDDVPADYFLVSSSLGSAAPMQVVVLPIMVEEQVLGVIELAGVKPLTEVHHDFLNQLMETIGVNVNTMVANARTDVLLTESQRLAAELQARSEELQARSEELQRSNAELEDKATLLARQNRDIETKNSEIEQARQELEARAQQLALASKYKSEFLANMSHELRTPLNSLLVLAQLLAQNPTRNLSAKQVEYATVIHSAGTDLLQLINDILDLSKVEAGKMDIAPEAFELRNLLDYVEATFRPLTTSRGLDFEVSTAADVPTLLVTDEQRLRQVLRNLLSNAVKFTEQGRVRLEIGLARPEELSPALAEQQTVVAFRVVDTGIGIAEQQLTAIFDAFQQADGTTSRRYGGTGLGLSISREIAWLLGGEISARSRLGKGSTFTLYMPVQSATVAGASIAEPAFNPGPLVTMPPAGPGGPRRLLVVEPHPEGLLTLIARGAATTLAETHGMFEVVTVVDPEAAIAELRSQTFHLVVLDPALQGFLKALHDETGLRTLPVLVYQTQHAPLGNDTLLQAFAQTRPLETLSSLDDLRERITLHMSAETGQPVMPATRPIESMAELTRAAGNLSGRKVLVVDDDARNVFALTNILELHGMEVVYAENGRKGIEVLAQNDDVDLILMDVMMPEMDGYAATAAIRAMPKYSRLPIIAVTAKAMHGDREKSLSSGASDYVTKPVDAEDLLACIERWLAQPPMGQE

SEQ ID NO: 15451 - protein, 245 aa, Actinoplanes utahensis
MESAVGDEMTVHRQTAGAAVADRDLRQLLAGLTAVRDGDFGTRLPEDGDGLLGEIATVFNGMVDQLSLFTSEVTRVAREVGTEGQLGGQAEVPSVSGTWKDLTDSVNAMAGNLTDQVRDIAQVATAVARGDLSQKITVDVRGEILELKNTINTMVDQLSSFADEVTRVAREVGSEGRLGGQAEVPGVAGTWRDLTDSVNFMAGNLTNQVRNIAQVTTAVARGDLSQKITVDARGEILELKSTLAS

SEQ ID NO: 15452 - protein, 1281 aa, Actinoplanes utahensis
MATQNLTCTLLPRGAGRHGGLRFDVHVAPQLTGDGADVTLGGQFPDFTDWPAAATRLGVSLRLDDGGTTTVVPGRRLSAPDSRVWTAMFTPRTPVRTPRVTEALDDVRVASYPIRQVVQFLSRQWGEVGVSAGRELPCLADFDRSPLRALGFQDGGLGQRRLNQLREDLRTRYQRGGGAVRADRGGLDDDQVVGMAFLQAGEFHSGTLTARRNPPPRLARRAAPAPAGHDFHDAVALAASHGPLQRLLGLVLEFETEPSPVLTALLTGASRTDLRFTLALGTDALRTTTTLRVPTVVCLAGAGRFEPAPRGAGVGAGLIRFAADTYSVTCLDADAGAQAVNQFAATLTGASDRDLAARDRREALPALRTGPMTVAKDDRAGELVDRLRDRRTEADPVLFAEDLVRGLRWDVRDGDGPWRSLMCREGFYEFHRLPGKGTVTVYDEAAVVTATTRGKDADHHDVPGDHLITESMMSWSGWSLAVEPLTRPVGTDNRVRDAAGDIDPAYQFGTRFRVPPGSLPRLRFGHSYRFRARTVDLGNAGVAATEDDLGEPDMVTPAATFLRYDPVEAPTVVPRQPPGPAEGPRYAVVHESRPVSSRHVVPPRTAQTMLEWHGELDRGRAGTPDPRAWQTLRARDDADLADLRAEDADCYPQELLDPPYLVDALAQAALVRGLPGRTTETVVDLDGSFRVDLRPVPPGGAGWRGRGRILEVGLEPGDIYRLRISSRFDPDDLAVMGVWDLMRTSAVGTDADVDTLRRDACEGRLWPLTPARDLMLVHAVRTPLPAPRWLTLKADRLFGEAPATITATMEISQKSTATLDVRGAWRMPVDDGPGFDTDPGIARDFRSTAYSVKVTHPEGAAPDTVQLPVGGTHHFTDHRYRRVSYTAVATSPFVEHFREETTVRLSTAAPARLSGDTEPFTVRVRDALTGAVFAPAPSGVTDPARAAGDFLVDPDRRLLHRTAGGRIAEGAKVVVSLVRGPLTRESAPIEVDVLSSVPRAPPRIHSVVPTFAWDDSVPGTSRRLGGGLRVYLERPWWSWGDGELLGVVLHAYPEVEPQGGFGGTRTDWAADPVTTAPRTVAGPMLSSFPLAVKTAEMLPVEGGSAHVAGHKVAFDPARDLWYADIRITDHDDEELSANLPFVRLALARYQPNALPDCLLSPVVAADFSQLVNGRTATVTRQGSDYVVTVTGHAGKADDRDLTHLCAFAEGRTAIADPELTWRALGSPVELSPIAAGAGQAWTGRVPRPGEAHRIVVQEYELHPTDNGTVRRVVYTDILTPR

SEQ ID NO: 15453 - protein, 606 aa, Actinoplanes utahensis
MPFTRVAAKLEVTPDLVLQDVPDGGGARMLLTADRKMLQFPWRGTDHAGQDTDFQAPAVFVPLGPNARRAPADDPLDPLTRWYEGNAEACTAAVGGLPISVAPADDPAATRLTVHTMSLGGKHLPGVAFPRVQDFTVEMPQLAAITGAPQSVGARFNYFSGYLQQGFKDNGGEVFLRMADKVVPELAVPGAMTGVATPQMAISGLSRSLGPVAGPLSDVANQKLDPAAILKDGARLLGDLRLIDVLAKPAGRANPEQAMKITTRDLPDGAETTLHWAPKLTDFAILKVNPASSLVLDIRIAARLGHPPTHDMRGTLSDVTLNFFTDDDPFIAVQVKTLRFTDSSGAKPDVHCDIGEVTFGGPLRFVRELATLIGFGRGNGVSVVPAGDRVTVALDVAVPSLAIGLLAISNIAVHVGLLLPFNGDPVVFDAGFATREHKFVLGVGILRGGGYAGVKISASGLQSLEFAFEFGAGVSIDLGVASGCVEVMAGIYFKLTATGDRQNIELTAYLRIRGSVSVLGLITVTVEFYLGLTYDSDGDRLTGEATMTVSIDLFLFSTSVSITCRRELTRSSSSFGRTAPAIASAPIRFGDVFTPDLWAQHCAAFA

SEQ ID NO: 15454 - protein, 245 aa, Actinoplanes utahensis
MRVTLTRSEIANGDESRPTTTWMPDDLAVARAVALRPDLHHGYTWVAYADGGRPLAVTRDGRWWLVGHPESTLGELGVTEIRYDPYDQDPDEAVRVLRAGGRAGRRGGRLLVQPRDTMQSRVWELLPRQVATPLMVRLGDDGMRLRKALRLTAYLHDPILETDIRNWFACRREPLWQLADFCSRLLEAHGYLDRQRALEFRVAGRLPAPRGGWQADPPVLGPDFTAVPITDPTARHALDHLARYL

SEQ ID NO: 15455 - protein, 330 aa, Actinoplanes utahensis
MTTMRAAVCERAGGPEALVVREVPVPAVRDGWSLVRVMAAGLNRSELRTRQGHSPGVRFPRVLGIECVGVVAESTDPSVPAGTTVAAVMGEMGREFDGGYAEYALLPNALLMPVRTDLPWEVLGALPETYLTAQGSLDVLGPPPGRLLIRGGTSSVGMAATGLAVARGFEVLATTRRPARTGGRLILDDGRIRDLWPGGPDQVLDLVGARTLTDSLRLVRPGGTVCVSGSLSGWAVPSFEPIAMIPAGTRLTAFHSGTMTGPRGAAVLQRLVDGVRAGTVAPNLDRVFGLDDIAAAHRYMEDDAATGKVVVTMVRDTGRDGRARAARSGR

SEQ ID NO: 15456 - protein, 251 aa, Actinoplanes utahensis
MPIARQPVSRLWPSGGAHLWPSGGISALHSHPRGHLVYAARGVLSVQSESGTSIVPANRVGWTPAGSGHRHRAHGSTDMRIVFLPAALSRLLGDRPAVFRVSGLAREALLALTGTPERERAVAARLRRVLVDELRVADEQPLRLPEPRDDRLRAVARLLYDDPADTSTLAALGRAAGASSRTMSRLCHDELGMTFYEWRTQLRIFHALVLLAEGHDTVRVAAACGWANPSGFITAFTRLVGTTPGRYRARG

SEQ ID NO: 15457 - protein, 53 aa, Actinoplanes utahensis
MSRFRSLQFPQSAPDARIVATVPARTTVSYPAAAAADTGTPPPREAGDDSSSV

SEQ ID NO: 15458 - protein, 54 aa, Actinoplanes utahensis
MKTTVRTTDWRIVTGASSCVADPSVRSRRCQTELLSSPASRGGGVPVSAAAAAG

SEQ ID NO: 15459 - protein, 690 aa, Actinoplanes utahensis
MTIRQSVVRTVVFTALYVVATYAGRLTIMDGTNLSLVWPAAGISALWFICQRSSRWRSLDVAALAAATVAVNMATGAGPALSGFFVVANLLQAATFTVLYQRWLPGLWGSGGTAPVARPHQLWRLVAIAIISTFCGALVGPTGVWLVSGHYSAPAAAVWMARNSASMLLIGIAGLRLGALAGRFTGTPRQRWPQLCAATRTVPGRTWVEGGALLIVSAGAYLAVFGFTHGLPLAFVLVTITVWAATRMSTTFVILHDLFFGSLAVVFTLHGNGQFAGIASHTSRALVSQMFVAVVAIVGLAVALGRDERVALQRAAAEQARVFATIFDAMGEGLAVLDADGHFLLRNPASSQLLGGLRSPTGRMAGNDFYGLRHLDGTPVAPGDLPHQRALATGDPHAMDILVSHPAVPGGRILSVRATPLPVDVGGRRYAVSVFSDVTADRRHRDELAAFAGIVAHDLSNPLTTVEGWAEDVADLLGPDAGRAGDGIARIQRAATRMRNLITDLLAYTTARDAALGLTGVDLTAIGTDIAVARIDQAETTGAPVPHVRIGELPPVHADPALIRQLFDNLIGNAVKYTAPGVVPVITVTGDRDGDRVRIAISDNGIGIPAGQHGAVFDNFHRAHRDAGYTGTGLGLAICKRIVVRHGGTITAADGPAGSGSTFTFTLPAANLPPGVPDPAAPVPERSRLA

SEQ ID NO: 15460 - protein, 193 aa, Actinoplanes utahensis
MSLIEVERKRALTDVAALTGRLRVQGYHEAATSVEVDTYYSRPDVDFLVTVECLRVRQRDGFAEITYKPASTGRTRSASGVIAKRETNVLLSGPEQAIAADELMTALGMVRLCRVEKTRTAFRNPEHDSVTVTVDRLAGVGSFVETEVMAVDEDAAARLLGQVERRLGLVDHAVVNLPYRDLVLQQERAATAE

SEQ ID NO: 15461 - protein, 470 aa, Actinoplanes utahensis
MPVTTAGLADRPNFARDAKTSTAYLDVAANTHGAEKGKLMHRALQRVQRRAPRAVELGPGGGAAVAYLASKLAQTAKPDRQVSLTLIEAPGVRSQSLTDAIDDFKRIGHCELRHGLAQDLNTLLPEPVDVISASALLHEVYSYGTGYAGLHAMIRTLPQVLTPGGFFAYRDVYAVDAPSLYERATQTYHSPTWLTFLRLFTPRYLAESTHPYHRADDEVVARQNSRMVPLGDLDPRTCAVISAPVGLFREIQRHYLTFRDHVWRSGLLGFTPVLDGDQADDWVDLHAGHKRVHFRMGGEVNWLPQPQSMMLAAMSEPYLDHHTIDSDIFDSVTEVALLAFLNAVTGDAACRTAWEAWLLREGRETYAYLTADQLLTAFVVHSTEADRDTVLMPIVAGDVGRVDRHYYNRFLARQLANPLRDAKQLVLFCNVPRNDTDTLRNGLGVLAERCSKPSLARIYTVITTDGGTAS

SEQ ID NO: 15462 - protein, 367 aa, Actinoplanes utahensis
MAFTRVESSAIGPGGVSVGATIAGRGDPVRRRDVLSGLTASAAAAALPHPDRRATPVANLADLLSAETMSTAPMKREILTQRLASARRLFSTSRYDELTGDLVALIAGAAATRRDGASAVREAATVILAAGYRLASELAVKRNDDALGWVLADRALTAARASGLPAPVAHASRSVAVAMRRAGHHDDAIALLMTSAQQLRLGPQPRDLELATYGSLLCTAAYASAQAGRRGEAETLLSEASAAAARLGAAVYAGELVFSVTNVAVYQIGVFTALGDSATALHHASTVEVATLETAERYARYCMDTARAWEQQGRHDRATQALCAAETRAPQELRRPSSHELITRLLYAPVVMPSGLRSLAARVGAIR

SEQ ID NO: 15463 - protein, 34 aa, Actinoplanes utahensis
MQDPTAGLMIGKAEFDRQAGLVRQAWRRRRVGVS

SEQ ID NO: 15464 - protein, 301 aa, Actinoplanes utahensis
MKPYLSATKRGLAAATATVIAGTLALASTAAPALASPGPTGVQYAYLNMYPAVPPTSTNPLVSVRQTVTCPAGTKLVGSGGGGGPYLGAISPSDDAATVDGQVVFDNGDHVVGELVCSPAAQFANVTTLMVTDNRVRPNTIRQTFAKCPVDRYAIGGGGGFNGATYLGGTSIFSNGPTPDGRSWELVGMPPAGASKLRMFVKCAPKTGQDLLITATSLVAQTSSLQPLSGRAYCPAGYLAVAGGYHVANPDGSSFLGGVQPPIMTWSVPVPPTTVGNDSNWYASGDLPTKTRLIISAQCVK

SEQ ID NO: 15465 - protein, 236 aa, Actinoplanes utahensis
MSGGRRRRPGPRFRPAARPDRRPHHRITSRVVTSQHASNHPTVVFYGDSIVTGWRGTTHPRARWSSLVSDELGWREVNLSINGMGYFRRRGPRGGDDRYLPSATDTTLLDAAIRLDPDAVIVCLAANDIRMLPEHADEVRAAIDRDLTRLRDELPGRPILVVTYYPVAELSERATLINNWVAGTAERLGLTYVDAFRRTVDGDEKLLCDDHTHPNDDGHRALADAILPACRALTLR

SEQ ID NO: 15466 - protein, 198 aa, Actinoplanes utahensis
MRLSGGAGGGQGGQPAESADLDDDACRRSRSRHGMLWHRHPGGTIMNLSIIGQAAGLFAVTNIDDILILALFSAQGAGHRHTTRNILAGQYLGFAGILAVAVAAAVGATLLPERAVPYLGLVPLALGIRAAVQAWRHRNDNGDDRTEATGDAPGIAALAAVTFANGGDNIGVYVPVFATAGVGAMTVYVVVFLLLVAV

SEQ ID NO: 15467 - protein, 71 aa, Actinoplanes utahensis
MSRYLTARTEGEGTDWAWPQGVLPILDWGCAMYACVDCRSVDGTVLLFEPNPGDLDEAWYVDSSSLAVIAS

SEQ ID NO: 15468 - protein, 264 aa, Actinoplanes utahensis
MIAQVPAVWNVDTNLSTVRDVLDEAHRGDVVVLPEGMLSGYDEDLTPLDALDPTAVHHAVAQVARLAVDKQVHVFCGSLLPQPDGWCNAGLFFPADGGRHQIYRKINLAMNERGRLHPGDQLPNVDIPLPGGPVTVGMQLCREIRFPEQWQYLATTGARLFVYLTNAANTREPEGVWRSHLISRAAENQRFLVSANIAHPDRHCPSMIVSPRGEVIGELPAGQHGVLRQVIGLDEAGSWYLGQRRQDVLSLDYHGSPLRPEQRS

SEQ ID NO: 15469 - protein, 135 aa, Actinoplanes utahensis
MRLVATIREVGESTSSWDPYTRGCPSRDLLDQIGSKWAVLVMGELGRQGARRFTQLRQQLGGISEKMLTQTLRTLERDGLILRTVYPEAPIRVEYELTPLGQTLRGPLKALTEWSTQHIEEVVDARKRYDERTGG

SEQ ID NO: 15470 - protein, 374 aa, Actinoplanes utahensis
MSIVVTAASGRLGRLTVEALLTRGVPASEIVATSRDISRIKDFADRGVEVRRADFAESGSLPAAFAGVDKLLLISTTTPSERVAHHRRAIDAAVVAGASLVAFTSMLHADTSTASLSTTHRATEEYLRERLPSVMLRNGWYLENYTDQLPQVLQGGALVGAVGRGRISAATRADYADAAAVVLTTDGHDGRAYELGGDEAVTLTQLAAAISAATGRRIGYTDLPVDAFARVLVGAGVPTELAQVLADADRAMSHDEMFTDSGDLRRLIGRPTTTPAEAIAAALRGPGGAALPPPVIDPGRMTGDLPHARTGRSMLRPVLSRPGRRAPGRSLPAPGTPEITTGVTGPVSGRTTPGWRPGCSPTVGRSCRSRCRWR

SEQ ID NO: 15471 - protein, 785 aa, Actinoplanes utahensis
MRHLLMVAVTAAAIGTLAAPAPAAAATTVALNGGIVGRAFDGVGAISGGGGNSRLLIDYPEPQRGQILDYLFKPGYGAAVQLLKLEIGGDANSTDGSEPSHQHVRGDINCNAGYEFWLGEQAVARNPGIRLVALPWAAPGWIGGGSFWSTDMINYDVSWLNCARQYGLTISYLGGWNERGHDSTWYKNLRTGLDNAGYSAVQIVGDDSGWGMADEFAADPTLKNAVGVLGNHYVCGYLSQADSCSTTGNARSSGKPLWASEFGSQDDNAGVVPYIRTVNRGYLDAEISGYMNWPLIAAITPNLPFATVGLMDAGSPWSGAYRVGRNLWANAHYAQFTQPGWHYLNSSASGYLGGNRANGSYVTLKSTNNTDYSTIYETSGSTAAQTVNVTVSGGLSTGTVHVWSTDMGSSNSADWFVRQADITPVGATYTLNLQPNRIYTVTTTTGQGKGTAAGPAPHGLALPYSDNFDGYAVRKLPHYSEDMQGSFETRACSAGRGGTCLQQVAPLRPINWQDDSDAFTLFGDTGWTNYTVSLDVNMQQAGTVTLLGRANIQNRPQNRQAAYQLRVTDNGGWSIVKHTNADTDTTLVSGTRAALGLNSWHNLRLGFSGGQITAAIDNTTVGTVTDYAYGAGQAGVGVVGYQTDQFDNLSVTPNSGPALNTLRGVESGRCADVPGASQTNGTQLALWDCNGGSNQNFTLTDQKQLLVYGSKCLDVNAGGTADGAKVQIWDCHGGTNQQWTLNADGTIVGIGSGKCLDATGHGTANGTLLEIWTCNGGDNQKWSRS

SEQ ID NO: 15472 - protein, 433 aa, Actinoplanes utahensis
MTRFDSAGLTRRSLIGLTGAAATATLLAACGSDDKSGTTSVSDGNGPITFGSNYSDEAPKAAFASLMQQATTSTTVPVTVNTTDHNTFQNNISNYLQGTPDSLATWFAGYRLQFFAAQGLLTPIDDVWDKIGGTFNDAAKSLSKGLDGHYYLVPLYNYPWVVFYNKSVFQSKGYEVPASWEAFIALARKMQSDGLVPLAFADKDGWPALGTFDILNLRINGYDYHIKLMKHEVPWTDPGVTKVFDQWRELAAYQQKGANGRTWQDAAKALENKQAGMMFQGSNQVAANYSAKNLPDLDFFVFPAINPQYGTDYMDAPTDGFILPKKGKNAAAAKKVLQYIGTAEAEAAFLKTDHWDVGLANGLIAPTYNDIQKKSVAEIGKCKSVSQFMDRDTVPDMANAMIKLIQQFIDQPTPETIATVQKSAEDQAKTIFR

SEQ ID NO: 15473 - protein, 326 aa, Actinoplanes utahensis
MTPTIRPAPAARRRRRTLTRRDVAVAAAMLGVPLLLDLAFIWFPALASVLLSFTKWTGIGSIRMRSCADFPSAPGIPQPGCLNGVDNYRQAFTNYPDFWPAVRHNAIWLVVFILLATPLGMLFAVVIDRGVRGSRFYQSVLFLPVMLSLALIGIIWELIYSPNFGLINTVLGHNHNDNLIDWLGNPRLNLWALLVEASWRQAPYVMVLYLAGLKAVDPALREAAIVDGANAWQTFWRVVFPAMRPINIVVLVVTVIESLRAFDLVYITSNGNPLRGLELLSVAVTQNIVGETQRIGFGSTLGVVLLVISLVPISLFLWQAFRREER

SEQ ID NO: 15474 - protein, 281 aa, Actinoplanes utahensis
MKRTGSQLFLLVMAVLWLMPIVFALYVALRPIEETNQSGYVSLPHQMTLSNFAHAWTRSGMWRFFLNSVYVTVPAVLITLLLASMAAYVLSRLGFRFNIPLLILFTAGNLLPQQVIITPLYRIYLAVHLPSWLSGSGLLYNSYAGLILINVSFQLGFCVFVLSNYMKTLPPAIDEAALIDGATLWSRYWRLTMPLCRPALAALATLLTTWIYNDFFWAITLISTGDRRPITSALANLQGQFVSNQNLIAAAALIAAIPTLVVYLLLQKQFIAGLSLGSTKG

SEQ ID NO: 15475 - protein, 724 aa, Actinoplanes utahensis
MQRHARHAIAAAVAVSLLPPSLPAHAAGASAVVPYAGNPASLKQDLCYQIATDRFSDGNPANNNPGNVPGMFADKTKLNDRQEWLKYMGGDFAGITQRMEYLKNLGVGAIWISPHVDNINVPANGATGYHGYWPRDFKRLEEHFGTDEEFDALVSAAHASNIKVIMDWTPNGTNPPNQAEDGALYDDGQLVGRYGADSAGHFHHGPAIGDFNDRYQDQYYSLADIADLDQQNPRVDQLLKDDANYWMDRGVDGIRVDAVKHMPLSWQRSFADAVTSHKSAAIFGEWYMGDQSDPLYADQVKFANTSGIAAMDFYTNRSIRDTFAGAGSMKSLDAAITKTNRDYLYEQDLITFLDNQDTRRFGTLNSDPAALHRALAFLLTTRGTPCLFYGTEQYLHNDTGEGSNKGKDPYNRPPMASFDTDTVAYREIRALSDLRRSNPAVAYGDHQQRWINDDVYVYERRFGDNVLLTAINKGSHEYRLDGLRTALPAGTYRDVLGGTFGGSDLTVEDGDGTDRSTVAPVLGAGQVAVWSYRAPVDTEPRIGGVGPVVTRAGATVTVEGTGFGSGGTVAIGGVPATVQQWTADRITATVPVGVPTGAVQVTVGNGSGTSNGYPITTRTGKPVPVQFTVQNPPATAPGESLYLTGDVAELGHWSTSPDQTAGQLLRVPNESRGVLVADLPAGAPVEFKFVKVAADGTVTWEGGANHRYTVPAGGTGTTTLTWQR

SEQ ID NO: 15476 - protein, 1033 aa, Actinoplanes utahensis
MDERLKSHIVRALLPVLVGAAGGLPAPRAAQAESPPDRPSHAEQLYLVMPDRFANGDTGNDQGGLTGDRLTTGYDPTDAGFYHGGDIQGVIDKLDYIQGLGTTAIWLTPIFKNKPVQGTGPNASAGYHGYWITDFTQVDPHFGTNEDLKRLVGLAHRRGMKIYLDIVVNHTADVIKNAEGTAYADKGTAPYRDTAGRPFEDRNYADGTHGFPKVDEKSFPHRPFFEKPSDATAKAPAWLNDPTMYHNRGETTFGGENAEYGDFTGGLDDLWTERPEVLHGLTDIYAGWIRRFGVDGYRLDTLKATDLAFWRPFAEGVGKAADKAGKRDFFLFGEAWSKDQEVTSTFVRRGGLPATLDFPFQGAAQSYVTGKAPASSLAGLYAKDDLYTAAGTDAGRLPTFLGNHDMGRIATLIKAGSDPNGLRRLELANELMFLTRGQPVVYSGDEQGFTGALGDKGSRQDMFASRTPDYLDDRLIGTDKTHASDNHDTGHPLYRTIAELGALRKAHPALRDGEQITRYAADRAGVFAASRIDRDQRAEYVIAVNNATTAQTVTFDTYTPGSGFQPLYGTGETAATGADGRLTITVPALSAVAYRAEKPIPAADGAPAVTITAPAAGTLVPGRTELTAAVTGDPLSTVTFSARAGNGPWQPIGTAGRAPYRVFHDLTGLAGGAEVQYRAVARDGRGRTATTTSRIRVGTVRAEAGYAVVHYQRPAGDYDGWRLHATGDVDAAALDPQGEPFTGTDAYGRFAWVKLRPGATKVTFTVSDANGVKDVDADRSLNPQQTPGIWLHQGDPAISYQGPAPAPAPNTAILHYRRPAGDYTGWGLHLWDGAATPTADWGAPLLPESFDSFGAVFRIPLAAGATGLSYIMHAGEAKDLPTDQRLEFADAGREVWVQAGVQERLLPSVVKPAKLDLTRADAVRVDRDTIAWQTGTPDTLEPAGAATDGRVYDLVHAPNGGLRLVDGDLAGDYRSIRLTAQRDGLTEKQRRQAPELWQYPAFQAAAALPSGDGQFYVTERDAQGRLMSVTGVR

SEQ ID NO: 15477 - protein, 325 aa, Actinoplanes utahensis
MPPMGARCSAEPFTGLADMVGHVRGILLAGGTGSRLRPVTWAVSKQLMPVYDKPMIYYPLATLVSCGIREILVITTETEAAQFQRLLGDGSQWGLRLEFAVQQRPGGIAEAFLIGEEFLAGGPVALMLGDNLLHGVDFRPCVQRARETAGGHVFGVAVADPSAYGVVEFDAAGRVLSIEEKPVRPRSPYAVPGFYLYDADVVETARSLRPSARGELEITEVNQAYLRRGALSVTLLGRGAVWLDTGTLADCMRAVDYVRAIDEGQGIKIGCVEEAAWRAGFLDTAQLRALAEPLMSSGYGQYLLALTGDGLSRTPQWPALTAAAG

SEQ ID NO: 15478 - protein, 320 aa, Actinoplanes utahensis
MKILVTGGAGFIGSHFVTSLISGDIATPQPVTQVTVVDKLGYGGNLRNLAEASADPRFSFVRGDICDEGLIEGLMARHDTVAHFAAETHVDRSVVASGPFVASNLVGTQVLLDAALRHHIGRFLHVSTDEVYGSIDTGSWAEGHPLAPNSPYAASKAGSDLLALAYHQTHGMDVVVTRCSNNYGPRQFPEKMIPLFVTRLLDGLDVPVYGDGRNIRDWLHVSDHCRGLALALGAGRAGEVYHIGGGWEATNLELTEILLEACGAPASRISFVTDRKGHDRRYSLDYSKIAGELGYRPRVDFTDGIAETVAWYRANRSWWT

SEQ ID NO: 15479 - protein, 659 aa, Actinoplanes utahensis
MAAGALGCGGHPAGRGGRCRRDPARLRRPGPWRAGGRPGPCRAAAGGRRRGGSGPARAGRQPAQRHRAHVAAGGGPAGAGPAGRHGDRARGAAAHRAQLPAQRDHRRDVLHPHSSRPALGRVAGRGPGNRAGQRERPAPGAGPAAGRGGRLTGFPAAAGHLQPGPVRTRPGLAGHRAPAVVGRPDPPQGRPAGHRAVAAARCGTGRGAAHPDRAQGEPRTGTGPGAGERLPRRPRCAAASGPGVGPPGRGERERIREREADVSGVETVGVHADAHRDSWQVRAQKQITYEVRFRDDVFGLDSTDLLEAGADGAGSRRRFVVVDSAVDALYGSRIREYFTHHGIDHSILVMRVGETVKDFDTAGRIVAAMDAFGLARRREPMIVVGGGVLMDVAGLVASLYRRGTPFLRVPTTLVGLIDAGVGAKTGVNFNGHKNRLGTYAPADLTLLDRRFLATLDRRHLSNGLAEMLKIALIKDAELFQLLERHGRVLIEERFQGRTGTGDRAAVRALRAATHGMLEELGPNLWESRLERSVDYGHTFSPTIEMRALPALLHGEAVCVDMALTTVLAYRRGLLDVAQRDRIFAVMTALGLPTWHPLLTPEVLEAALQDTVRHRDGWQRLPLPVGIGGVTFVNDVTAAELQAAALMQHRLAEDALLLRA

SEQ ID NO: 15480 - protein, 251 aa, Actinoplanes utahensis
MSGTLVGRRALVVGGTTGIGRGIADAWAAAGAEVTVCGRSEPAGDGAAGLHWEPLDLTRTGEAGARLERIAGDRVDLACFAAVSYGARRAVFEDVAVDEWRTQLDINVHGLWLTLRAALPGLRAARPGLFVGVSSEVVYNAGPGRSGYTASKAAAKALLESVAQEEDESRVRIVQVLPAGMVDTPSIRRRRPAGFDYSDYMVPADFARNALELAATAGAGHHGDSLVVDRGGDWWSVRERMPVSQSRPVRT

SEQ ID NO: 15481 - protein, 366 aa, Actinoplanes utahensis
MSRHRAIVRTGTGVVVADVPTPVPGPGELLVGTEWAGLCGTDIQMLRGLRDDPEPIIGHEGIARVIAAGDGVPGTLRPGTLVAVNPTHRDDPSFLLGHNVPGLLQERTLLPATAVSGGLVLPLPDGTDVTLGPLLEPLAVVSYALSQLGAVRPATLVIVGDGTVGHLAARAAVTWLAERPRVVLVHHTAAGRDFSAAGPHPADVLLTTGELAGRPLPGPVAALLATPRDATVEALEAVLAAAGADVLIDVLGGLPPGARSAMLPGVDLTAVRAANCGGFPEPALVTTTSGGTRLFGHRGVGNAHLRAAAGELARDPDRYRDLVTHRSDLAGAARIMTALRSGRDRIIDGRRLVKLAIQVNVREDHR

SEQ ID NO: 15482 - protein, 380 aa, Actinoplanes utahensis
MHHPRHPGRRHRPGRAAAAGGVKRPPHHPVTVADVGGTHLRWARWSPDGGLGEVHTTPSPGHARRPGAGAADLQAELIRELASRVEPGARAGVSLGAAMDHHSGTAYASAPLWGPQVSPFDVPAALRAARPDVHWTVVNDVTAGLLHLAEMVRDAGVRKACLVTISTGIACRTMDLRTGGIPVDAAGLQGEIGHLPATVLADGVPVVTRCDCGEPGHVAASSSGPGIRRVAAVLARRDPATWAGSGPTTRMMAGSGFEDAFRAALDDGDPVAADLLTAVTAPIADLLRTALCLDPELDLIALTGGVAHGLEPHYSAAVHDHLRRRGLYLTSEREPDWLTGRIRVVPPATADPLVGAGLAALAAGPVPAYSGGGREALVGR

SEQ ID NO: 15483 - protein, 299 aa, Actinoplanes utahensis
MSEHTDVLVLGGAGVDTIAYVPELPLPFQDSYVVAAIEPRAGQTGDNVALGLHTLGLRTMHVDVLGDDPEGDLVRAFHTRHGLPFAALPTAAGTKRAVNLVGPDGRRLSLWDGSREAEEDRYPAALIAAHTAHARHVHVCITPPGQHVFGQLNDLPVTVSTDLHNWDGAYEGFEVYAFNADLVFLSATALTDVAATMRRVIDRGRARLVVATDGAHGGSVLVRGETEVRRYAAVAPEAPVVDSNGAGDAFVSGFLFGHLAGEPLETCLRYGAIAGAYACTIPATRAGAIDRAALLRPAA

SEQ ID NO: 15484 - protein, 698 aa, Actinoplanes utahensis
MTTTTDAALIELAGRYGVSVDWTTDRGEPRTVPADTIQRILAVLGVDASSGPAIAAALRAADDDARHRLLPSCVVVRQGEPARGVHPVAGAAYVVATEDGGRHETADPRNDLGRLPIGYHTLRVRVGDRSAAAPVIVAPAVLGTPDRRHWGMLAQIYSVLSERSWGMGDLGDLADLTRWSARLGASFVLVNPMHAYVPDRLADPTPYRPGSRRFADPMYLRLADVAEYATAEPAVRAELDRAARQGHELTAEVLHRNALIDRARVWPVKRNALERLYRAPRTAGRSAALAAFTAREGRGLEDYATWCALAEVYGTRWRSWPAALQSPHGPAVAAARRELVDRIDFHRWLAWLVDEQMAAAQAAAVGSGMAIGVIHDLAVGVDPEGADAWAVQDHLAGGVTVGCPADDFNPLGQDWGLPPWRPDTLAEAGYRPFADVIRGTLRHSGALRLDHILGLFRLWWIPAGSGARDGAYVRYDHEAMLGVLAVEAFRAGAMIIGEDLGTVHPAVRAELADRGILGTSVLRFEYQGGSENRSGPLPADQWRAGCLATLTTHDLPSTAAWLSGEHVDLQDRLGLLNRPRAEVAADAAAERDGWLAELRRTGLLEHETAVPGMSAESLALHRFLARTPARLVGVWLPDLVGDRRPQNLPGTSTEFPNWQLPVADADGRPVAMDDLASSAGAQAVAGLYAASAEPATTP

SEQ ID NO: 15485 - protein, 283 aa, Actinoplanes utahensis
MDGIGTTPPRDHRVVATDLDGTLLRSDLTVSARTRAALRDARAAGMIHLAVTGRPVIDTRRLLAGLGYTGPAVCGQGAQVYDFGTDRLLLSRSLDTDLVRELVRRIAQRTGPLALAAVSAGLGTEFLVTAGFGAPYQQHRWQLVDEPDLWRAPVAKVLIRHPDHDDDTLAALADEVCGAALSVMHAGPGLVELLPGDTSKRTGLAFLAAELGFTGADTIAFGDMPNDLPMFDWAGYGVAMANGHPRLRDRADEITVSNDADGVAVVLERLPAVRAGNRKASLR

SEQ ID NO: 15486 - protein, 734 aa, Actinoplanes utahensis
MHVVSFAFEALAFDVGMMRGGLAPLAWELARHYAAQGHRSSIVTPAHGRLPYLAERYDLVELDYRDEHVVPVVPDPDVWAGQPRELGLPLVTRAHLLRHEGVDIYLLSDEYLDLLPERLYPAGTSEGSDLAYFKPLVFQVGGLRFLQSRLAGDEPAVVQAYEPYYHYLLPPVLAGDPRFRVMSTVASSMPIDLGVYRPQVDRLLEHFGAGTDLDRYVESPVAAGADHPAATREAALGAAMAGYLPTTRLSSGRRRADYVGLFALITDHCDTVDFLTPGQRRFYSTFRDTPYEAAFRRTAVARVVRENAAKQFVGGCALPENWLRRDPAEVDRAAYLSGLGLDPALPTFYHVGRYSPHHKGQVELFRAVERILATDTRVNFVLRCATSAGGGGARIGDPAFQAVADRHPGQVRLFWTMADEDELFTEAVAADFGLFPSKYELDTFLTAQGQLCACGAVPIGTAQESTRHYRHQLATDHPLATGFALPRSFTPDDERLTGALVRTMREALRMYRDEPGEYRRLAGNAAELARTFRYAEVSRRRLAHFAKLLDGTPTAADPEHVIGCGWFDQLDAAQWAAHLPQIRREAIRLGDLETLRRCGPVDPGALGALYEAAYRRADFDRCVRVAELLGDRGSEAVSLRRRCRVRPHEQGWEIQYRAPGAEQVALVVGGTAHRMHGSAGRFSTVLPTVPMPSPVFLLTLASGRYAWDAPPATAHLADLAGQPHPAQPVGAGGR

SEQ ID NO: 15487 - protein, 195 aa, Actinoplanes utahensis
MTGAVRAVRSREVYRNPWMSVREDDIVHADGSPGSYGVVTKPDYALIIPRDNGLLHLVEQYRYPVGGRFWEFPQGSWPADAAGGAADLLARTELAEETGLRAGRLTPLGRIHVAYGYASQGCHVFLAEQLTAGRSQRERTESDMRQRAVDAAGWADLVGSGRITDAATLAAYTLLRMYDSGTRQPMPEGAESCTW

SEQ ID NO: 15488 - protein, 363 aa, Actinoplanes utahensis
MSTGVRAVLLAGGEGRRMGALGAGRLKPLVPFGGAARLIDFSLANARDSGLDQVLLLSQYQERQLMDDLRRTWWQPGFRVHFGPYDRAYTDGIPVEYEPPTGPPERGTADALIRKAPYLFGPDVTEVLVQHADHVYRFDYRPMIAEHRASGAALTVSYQRIDRRYVHLFGMVEFDDRNRLVSFVEKPAEPTSDLVFAAFCVFDAAVLHRYLELLDGTDWQHDISRDVIPAMLAAGEHIRGCPVPGYWADIGTVERYHEAHLSLVGTPPSLAVDAMPWTVAPRTARALVTSADGVRHSVVPADLVNHGTVERSVLFPAARIGPGATVRDSVLLPGAVVPAGAEIDGAVVLEDGTVQQVTTGARR

SEQ ID NO: 15489 - protein, 709 aa, Actinoplanes utahensis
MHIIETYFECGGFDHRFIQGGTSVYLWQLSRGLADLGHRVSIVTPAHGRLDDLRRLHEVEDLPGTDEYELPLVLDPRVWGERFPAQMDIALRTTAHRIRLAGVDLYFLSNELLDQLPDRFYPPYESKGVDLVFFKPLAYQVAAIRFIRSHFGDQRAIVHAHEPFYHYLMPAAFAADPAKHVVSTVQSNMPINKSVYRAEVARLLGFLGAPNALPADDPAGSRSPHTVAMSQYQQLTHLHYEYPPDHVRVYDLVAEHADRIDFLSPGHRDYYTCFADTPFAQLFATLPVSRTVRRNADKTFVGGCAVGDEWVTGELPPVDREKVLAGLGLDPDLPAFYHNARYAVNHKGQVELIRAVDRVLSGGVRASFIVRCLSDAGIADPLFHEVVARHPGRVNLEWHRVPEDQLREYARAADFCLFPSKFEMDTFLIAQGEAMAAGAVPIATAQLGMAHFGHVADPLTGPDAATATGFAVNRSFAEDDPLLVQGLTEQIRRAVTLWNEQPGQYRRLSANAVARAREFTWRRAAQAHEAAFAGVWAGRTPRLPVGDLLRFGWFDELPADAWTLHRDEIAEVALAHGDADAYLRCRPDDLDALAALFERAWARADFPACARTVELAEEHRQERVPQWRARLAGRGRIDRDGRLHYRPPSAERVELVLPDLAEPLRGTVTVTAMAPTGDTFTGQLPAGTRRADLLLTLSDGRTVWDEVTA

SEQ ID NO: 15490 - protein, 492 aa, Actinoplanes utahensis
MTPRPVSTIDVSLASLLRTADWPHEDLRGPGGVRILDEAILGPSRLLIVAAERNPESRYFVAVLRHDPSREAVGDAAHDRAVVQAMRERLALPTAAGHLIVFDGDPAPFRATRPFDPGWSTNALSLADLDGTLHIHKAYRLVSAATREPHLLRLMHRGGRTQRWAGDYHYVEQPSGRRYPLGLLYAYAEGDSLDLPLRHSIRSMWPALLGGTEPAGAVTAAQRSIAGELPGVGRFLRDFHTELAQRLEPAPTFPVNAYLRETAERVAALGCRISADERYPRPVREAVVAALTGELDQATTSAVRVPWPAGPSHGDLHLSHILRRQTPDGWRLCVIDLSTPAPDPADPLGAAQSPWQDLVALLRGLEIFTADEFVHQAALRLGADQDDTCRTVLLISAGQTPDTPGWTGSRLTALRRMHDAASVWAGQVRRMLLSGYADGGEAAEEHPAWRIFRLRRLLHELDYAYAHDQHYHAAINLRHVLQTYRPPVTGES

SEQ ID NO: 15491 - protein, 449 aa, Actinoplanes utahensis
MFRAGSFRHRRRDPAAVPVSRQADLLARESRHLAPGASEEAALGRRVFVEGRGATLRDADGVEYLDFAAGTLTQSLGHCHPEVVARLTEQAGKLWNVHDFATADRAALCELLAELLPDHLTTLAFFSTGAEVVEAALRTVQAVAEPGRNRVGALRHGFHGKTMGARMLVHWDVGDQSFAGNSVLGYAPYCYRCPLELSYPSCEVRCATLVRRHIAEKPNVSALFFEPVLGAAGVIVPPPGYWEQIAAACRDNGVLLVADEVLTGGGRTGTFLASEAIGVAPDLVTLAKGTASGFPFAVLAGRDEVLRHPRAGLAGSTASTYAGNPLGIAAAHATLSVISRDRLIEQVRDLGAVLADRLAEMHDRHPHLGDVRGIGLLHGLEFVHDRQSRRPAPEIARRVYTTALDAGLRTAIGGHIIRLAPPFVIDETELLRGLDLLDRAITEAGRVTA

SEQ ID NO: 15492 - protein, 357 aa, Actinoplanes utahensis
MPGYARHARPDGTTGMIVAEHLSKHFKRYRREPGLRGSLRTMFSARYDVVRAVDDISFEVPSGVKIAYIGANGAGKSTTIKLLTGIMRPTTGRVRVDGLDPHRQRTRVAGRIGVVFGQRSQLWWDLPVLDSFRILRHVYEVPQAVYDRNMRLFRDRLDLGALGNTPVRQLSLGQRMRAEIAASLLHDPAVVFLDEPTIGLDLVLKQAVRDLINHIHAELGTTVMLTSHDIGDITSICDQALVVDRGTIVHQGTMRDLLRSVDTRAVTFEYAAGSVSEAAALRIITEGLPEVDATPAESGRIRVEFPVDRWSARQVIAFLLDRFDLSDVLVPDADLETLLRRIYAGSRPEPVTAGDGA

SEQ ID NO: 15493 - protein, 267 aa, Actinoplanes utahensis
MIRAARRYAPFALAGLHAVTRYRSTIVLSALTAAAATSLQVFLWRAVYAGGPAPAGLPFAQLTSYIVLAQVLGMLHTNRIDEMIAGEVYRGDIAVSLVRPANYALSCLAVNLPTAALSALLAGAPVLAGFAMFASLPAPPPANLLLFAVALLLSVILAFEINFLVGLAAFVTTNTWGIRTIKNALVAFLAGQVVPLALFPDGVARLLRLLPFQGLIDSPLRLLLGGYSGGSGAAAILGVQALWAVLLYGVLALAWNRSLRRVEVLGG

SEQ ID NO: 15494 - protein, 267 aa, Actinoplanes utahensis
MTVSTARRYLRLTAVLCGASLHRLTAYRMDFLIGAASFVIRIACQIALIGVIFQYVPALGGWTRQQALFLLGFSLLPRGLDRLFTDQLWILAWQLVRTGDFFRYLIRPVNPFYALLSERFLYPDGFGELATGIAIVVTAAGTMDLHLTVAQWLLLLPLVLGGALIHTFLKAFLASLSFWMTSSLNVMVAVNQLSEFTAYPLNLYHPVLRGVLTWVLPFAFTAYLPVRYLLTGDAGPLLWMLPVTTLTVLLGYGTFRLGLRRYEMPGS

SEQ ID NO: 15495 - protein, 1075 aa, Actinoplanes utahensis
MVLSRHRDVMRRLSAVLALGLVVPLLLAPPWRASAAPAGAAEPSAAALAHWGADRPAPAEQFYFVLPDRFADGNPKNDTGGLSGDRLSTGYDPTDKGFYHGGDIQGVIDKLDYIQGLGTTAIWLAPVFKNRPVQGTGAAASAGYHGYWVTDFTQVDPHFGTNADLKRLVQLAHRRGLKIYLDIIVNHTADVIQNEGGKSTYVDKADAPYRDSRGRPFEDHNYADGSRPFPKVNLQSFPYTPVFASPADATAKVPAWLNDPTMYHNRGNSLFSGENSEYGDHTGLDDLWTERPEVVRGMTEIYADWIRDADIDGYRMDTVKHSNIEFWQQFNPAIQQAARRAGKPGFFMFGEVFSADQEVESRYVRQGGLAASLDFSFQSAARTFVSGDTPATALADLYRHDDLYTARDTGAGRMPTFLGNHDIGRIGSFITTGGADRTSYLRRDQLAHELMFLTRGQPVVYSGDEQGFTGPGGDKDARQDMFASRTPDYLDDDLIGTDRTHASDNYDTGHPLYRTIAELGALRKANPALRDGVQITRYAAPGAGIFAFSRVDPVRRQEYLVAVNNATTAQTATVGTATPGSTFTGVYRAGGTAATGSDGKLTVTVPALSAVVYRGGSPIAVPSARPTVRISAPAAGASVPSRADLVADVTGDPLATVTFAAQAGSGPWTVIGTARQAPYQVHHDLTGLAGGVTVRYKAVVRDGRGRTASSTSSLRVGTPDTHVAPERMVVHYQRPAGDYGAWRLYAFGDIDASAQTTYPDGQPFAGQDEYGAFAWVRLKPGAKNAGFVVVDGNGVKDVQQDRFVDPGRQPEIWLKAGDATVYPSRQDATGRPDPQPDPKTAVLHYRRADGDYTGWGLHVWDGAAQPTEWTAPLAPSGRDAYGVTFRVPLADGATGVSYVLHAGDTKDQPTDQRIDFAAGREVWLLDGVAERLLPVTRRTAAGAGIDVTTSRAGWASRDTVVWNTGVGSTLQPVGGGTDGRVYELAYAPVGGITVVGGELAGAYRTLRLTAQRDGLTESQRVRFPKLWRYGAFRVADADRHRLATALRGQVVITERDASGKLLAATGVGAAGDLTG

SEQ ID NO: 15496 - protein, 423 aa, Actinoplanes utahensis
MIQRNRQVCDARNESVALISRVVAERAVEPLFQPIVDLDTRRLVGAEALARGPAGSPLEFPDQLFEAAARVDLVPELDQLCAARAHEIAQAPGAVVPPLVFINKEPAGADRPLSEDLRLRLASISTYRYVLEFTERALAAHPSALLEVAARAHRTGGALALDDVGADRLSLAFLPLLEPEVVKLDMHLLRDPYCAHTIETTALVCGYAQRTGAMVIAEGIETEQDLQVARALGAGWGQGWLFARPGPLSAVRDWPVDPSARLRAPRPELYVPGASPFDMASARHRARTGDRHLLDGLTAHVLRQLPFAGPYGVVLGAYPDLATGHGWIPRLADAASTAALVGVSGPGPGLPAPSPIRTSITDGLSGVESEAALVIVDPHVTVALCTRRRHDDAIDFVLTFDPDEVHAVARTLLHRLGPQDLPG

SEQ ID NO: 15497 - protein, 500 aa, Actinoplanes utahensis
MAPDLPRRLARATLALAMTLTAAIGTLLTATTPATAAATTSNLVAPAPYGADPWMGYYNGNYYLAATTWNNQVVVKKAASVTQLSGAAYSVVYTGAGSTVCCNAWAPELHLLDGPNGKRWYLYYTAGTAACCDGQRSVVLESSGTDPMGPYHFAAQLPVQNNGWAIDGSVATIAGKLYFFYSAWVGDQQSLFIAPMSNPWTISGAATRIAAPTNAWETSGAKVNEAPHILQHGGKTFLTFSASSCTTPDYKIGMLTLTGADPMIATSWVKKSTALFQRSDANGVFGPGHHAFFTSPDGTETWMVYHANDSATQGCAGTRTARITKVNWNSDGTPNLGTPVASGTTITAPSGDPGGTVTFPVAGTRYRLVNQSSGKVLDATDCGTANGTGVRQWSSLGNSCQQWSFTRVAGGYYTITSVNSGKVLDSVNCGTADGAGIDLWTALGNACQQWSVTPVGTRYLIANRGNGKVLDVADCSAADGAAVRQWTALGNNCQSWNITP

SEQ ID NO: 15498 - protein, 521 aa, Actinoplanes utahensis
MQGRGAVHRSAPRGDQRFVWAGLLAACATSALWLVVQALNPGWLPNVAWIPGGVTLLLGAWAAWRIARRGAASADGRRFWTQIAIGTALVTPGACLINAVNTGALPAAAAVLVVAVSFIAVALLLMIGALLRLPVADRARGQAVRLGLDAATIMVVAATVLWEYQVRPMIGSDPQLRTVIGPLLVCAICMGAVLAVVKLMLAGTDAVSVRSLQALGLLVLIGALASALTRILEHDARWLGVGPLISTVEGVLVVVAAGQPPAAAGAAADRRSTFSVMPYVAVGVIDSLLLIHTLNGRQNTAMVIGSVLVTVVVVGRQIIAFRDNTHLIDSLREHRRMLQHQATHDPLTGLANRALFYEDVSAACAQHDATVLLLDLDGFKPVNDTFGHAAGDALLVEVGRRLRDTAAQAQRVARLGGDEFAVLLPSSDQDTARTAADRIIAALRPPIATHGVTLPVRMSIGIAVYTDGDDAESLIRHADLAMYEAKAAGKNRHATYTAEGRHRIDADADGRLCSPLSEASA

SEQ ID NO: 15499 - protein, 589 aa, Actinoplanes utahensis
MAMRIEDYAIVGDLHTAALIGRDGSVDWLCLPRFDSPACFAALLGDEGAGRWRIAPAGAGVATRRRYDDDTLVLETEWDTPDGTVRVTDFMPPRGEAADLVRVVEGVSGSVRMRVDLTLRFDYGHIVPLVRRTRHGWHAVAGPDAVWLTTPVPLHNHDLTTTAEFTVTAGERVPFVLTYRPSHEPAPQSAEPDAALRDTRRFWQEWLGRHDYDGPYADAVRRSLMFLKALTYAPTGGIVAAATTSLPEQLGGPRNWDYRYCWLRDATFTLQALLGAGHVSEARAWREWLLRAVAGDPADLQIMYGLDGTRRLPEYTLDWLSGYQGAGPVRIGNAAAGQFQLDVWGEVLDGLHLSRESGLAVKDDAWDVQRSLLDFLESNWQHPDNGLWEVRGPRRHFVHSKVMAWAGLDRAITAVEKHGLPGPADRWRAIRDAIHAEVCDRGFDPSRGTFTQYYGSAGLDAALLLIPQVGFLPYDDPRVIGTVEAVMKDLCHDGFVLRYRPDQDGVDGLPGTEGAFLACTFWLVEALHGIGRTVEATELFERLLSLRNDVGMLAEEYDPGSGRHLGNTPQAFSLVGLVNAARRLGRPQG

SEQ ID NO: 15500 - protein, 190 aa, Actinoplanes utahensis
MQPSSDAAPGAAVQALMLASRAFVGITVRALAAVPGEVTLPQFRTLVVLAARGPQRSIDIAEELGVNPSTGTRMLDRLIGKGLVRRTRSATDRRVVRLRLTPDGQRLVEQILDRRRRELERLVDGNPGLWSPPVIEALTAFATAAGEQAAATERSAAGKPPAVGAQAAGPSGPDWWLGWTPGDAVGENIA

SEQ ID NO: 15501 - protein, 316 aa, Actinoplanes utahensis
MTRTGAAAGHHGYYHEALCYAADDELLAVVVPFLLGGIAAGEPTMIALGERTGELVRSALPAGTPVTVLAGGAMYARPASAIRAYRNLLTGHVAAGATQIRIIGELSPDTFGPLWDSWARYESAINHAYDDFPLWSMCAYDLRVTPAPVLADVLRTHPRTAAPHGGHVPNADYTEPMLYLSDRRVPPPDPLQCDAPAADLSSPTPGEARQAVRAAGTGVVGPDELEDLVVSVSEAVSNAYRHGRPPVRMRLWCGPGRLVVSVTDAGSGPKEPFAGLLPTGDGVDGGLGLWIAHQSCDHVALYRDTDGFTIRLTTGR

SEQ ID NO: 15502 - protein, 260 aa, Actinoplanes utahensis
MERAGHECWSYDDQRVIDAYAREVILAGIAGGERVWYVPGRESELTAQALPGGDAVRVVHFGDAYSGQAVLDPVAQVGAYAAATEEALADGFTGLCVVADVTELVRGDEQRDAFARYEYLIGRYMRTDAMRAVCAYDRRVLGAAAVAEIACLHESSTGAGVPFQLHPALSRAEAVLDGELDPAGEELFATALRRTDLAPAGGEIVVDAAGLRFIDHRALLVLQRYAESRGLTAVLRTRFEAAARLAELIGLTHVRVEPAA

SEQ ID NO: 15503 - protein, 392 aa, Actinoplanes utahensis
MARRETPAAGPGSRALIVDVVRSAVSISRVELAERTGLTQPSISNIVRDLIADGVIHETGSEDSVRGKPRKLLAITPATRFGIGFQLGPDTVTCVAIDLTGGVVGREVVPLDDTGLADQLAARFDDFIVDLDLPRDRIEGLAVVAAAAPPSHRDNPPEWAAARRALAARLGIPVLVENDAAAAALGEFWTRRVSREQAFGSVYLSAGVGAGLVFGGALFRGTSFDAGELGHLSIAYDGRPCPCGNRGCVERYASMAATVEAARDAGLAVDQKSMFSAYDAIAHAAVSGDPDAFAVVDRAAGYLSVAVTSMANLLDLGRIVLTGPGMAIAGSIYARRLRSHLAATAHARYRHDVVVELSAQPRDAAGIGAAALVVQASIAPGHTAGPAGPDGP

SEQ ID NO: 15504 - protein, 302 aa, Actinoplanes utahensis
MSPDLHVRAAAVSGDTVPVGSEGTEESVAQSQRRVGLVLARASRVLGEEPYYHEFIEGLERVLTPDGVSVLVKVVTDRAAENATYQRWAAGQRVAGVILVDLQPDDERVTLVRELGLPAVVLGAPSTASGMPTVWTDDAGYAREAIRFLVDGGHATIGHVSGPLSFAHSQLRREGAQAEAAELGVTVVPAEGDYSYESGRAATAALLDARATAIVCDNDLMALAALDTLREREIAVPADMSVVAWDDSALCQLATPALSAMSHDVVRVGEIAARAMLDAMAGKPPAVYQAPLAHMVVRESTN

SEQ ID NO: 15505 - protein, 336 aa, Actinoplanes utahensis
MLSAMTIPRPVWAVGSVLALAAALMIHNAPDASAFAATPKSAVINYLKSITGTSIVSGQHNKEPANLPGQYTQQVHDVTGQWPGLWGGDMMFTATDIANRQSVINQAKTEWANGSLVALTWHACSPTVGATCNFDGGVKTGITDAQFQQIVTPGTTLYNTWRSRMAAVVPYLKQLKDAGVPVLWRPFHEMNESWNWWGHRSGANGSLKLYQQMRQYFDSQGLDNLIWVWNVQDNPAGGWAGFYPGSSYVDVVTLDAWYKNYPSAADYSQIQSIAAGKPIAIAEMGKVPTAALLDSQPKWTYFMIWSEQLRGNNTNAEIQTSYFLPRVLNQGEVKIS

SEQ ID NO: 15506 - protein, 313 aa, Actinoplanes utahensis
MRRLTVYAVTALSLALTTAAPAAAGPGTCPRPGGQTMTVGYGGREYPVTVYVPAGDRPATRRPIVLNLHGSQSTGGDQLHYSDMAAAADAGGYLVVAPTAAIPAGDGFSWNVPGVGSPPPGARDDVGFLDRVITTAVRALCGDPARVYGTGYSGGGRMLSAYACRRADRLAAIAPVAGLRAGRPDPQDSTRPDPASCEPSRPVPVITFHGLQDATNPYAGGGSPYWGYPVPLAQQRWARLNGCRGAATESAVSPHVTRTAYRHCRTGAEVTLYTIADGGHTWPGTPIDNGNGTVTHEISANALMWQFFQHHRL

SEQ ID NO: 15507 - protein, 125 aa, Actinoplanes utahensis
MTYRPVQQAHEPVGPWVLAIGSMVMALVAPAVGALSAWSYLDVTPHCRSTWIYVVAVAFLILIVPSLLCLGVASFGLARYRAGTGSLRVVSRVALAVTVCLTAPVVVGGGVLGATMVLFADDLRC

SEQ ID NO: 15508 - protein, 170 aa, Actinoplanes utahensis
MLGHDGQQGGADRPALRVPVHDFRHLPPFGYSRILKEVGMSHDDTRAADSDRAATIERLTAALAEGRIDLAEFDRRTVVAAGATTVGELVPLTADVPVPARQAQAEQRRRDRSEWLTEWRYWLGGALIMNAVWGTQCLRDGQLQRYWPVAPLGIWAAVLIAVAIWPRDRS

SEQ ID NO: 15509 - protein, 208 aa, Actinoplanes utahensis
MPKVVDRDAQRRAIGAALLTVVAEHGLEEVSVRTVAARAGRSPGAVQKYFRSKEEMLLLALDIAGEKAEQRLRAVDRSGTPRQVLHRLVVATLPLDPERRAEAIVWAAFAAMAVRHPPFAEVLREIDRAVSADLVRWLEAGRADGTVALRGDPRRTADAVVALSDGIAARLIYHPEAADELLAALDTALDALLSPPKPPQPGDTAQTT

SEQ ID NO: 15510 - protein, 540 aa, Actinoplanes utahensis
MDAGPLTGERARWRSPADLGVGVRILSAVGLAGAVALTVGITGLAGLRNTSDAARAISTKNVGGIKAVGELMSAAAQAQADSANAALSPTESASQYFTQAFESDLTRFGDTLSAYRRTAPAASAATIDDLAQRWSAYTAIAGGKLQALGDSNDLGAWSRVRDASVTPVVEKLNADLAVLRDAETAAARAGSAAADTEYSHNRTVSLLVLSVGLLLALTLGVLVTRRIVGSLNRVKRVCEALAAKDLTRTSGLTTHDEIGAMGQAMDTAVGALRGTVTTIAGSAAALAGASEEMTGTAAQMAASAQMTTTRAQEVSTAAEEISRSVEAVSAGGEQMGASIGEISQNAAEAARVAGEAVALAAGASASMRKLGESSIEIGNVVKVITAIAEQTNLLALNATIEAARAGEMGKGFAVVASEVKDLAQETARATEDIAARIATIQADTGSSVNAIEEISRVVARISDFQTTIASAVEEQTATTAEMNRSVGDAANGTGDIAAGITGVADAAERTSEGVSRTQQATTELSTMSADLRALVQAFRV

SEQ ID NO: 15511 - protein, 381 aa, Actinoplanes utahensis
MRTRRKAVGASGANTAGARGRRHRGMGVRLIGIGQSADMNAVGKWYMHRVRTNARSGDLRVTSGVTIGALFASCGLYALAMTLLPAQPDAGRGNTVMVALVAVAFGVVFMPLPWERISDGMRLAVGPLGMGLTGLYNIASGLDPFRYGYFYLMVILWYGMCERRGMTLKTSPFLIVAYLLPLILDGASASDLASIGYALPIYLLVGETLAWRTDRARRLQRRLEQLAHHDPLTGLPNRAVFTAELRRRCAGPEPVAVLFLDLNGFKQINDRLGHAAGDDVLVQVADTLRTAKRRGSRDLACRLAGDEFVVLLPDTQLEVARALAERIERRLGELSATDGTPVGASVGVAGGLSMDPNDLLAAADEAMYLAKQARRPASEAS

SEQ ID NO: 15512 - protein, 306 aa, Actinoplanes utahensis
MIMTVDTNTSAQPPTPRPADGLAAPMNPHGLPPAVFDPARLAAVRSTGLLDTGPEEEFDALTRLAVQVTGAGRAFVTVVDDRRSFWKSCIGGPDLLVEQRQNLVHESPCHLLIATNRELISDDARRDPRIRDVPAVEQLGIGAWAGVPVRDRDGQVIGGLCAVDDQRRAWEPHQVETLHTLAEAASAQIKLRQELDRSRAQAARLDATARAERQLRAEADRRAAAAAELAAQMRVAVTAQATLPRPEHCQLGGTGGCTAPADLKIADSWGDSAWGCTAHVEEALITVRSVFVANEELGGLAAYLHR

SEQ ID NO: 15513 - protein, 207 aa, Actinoplanes utahensis
MLIALGPILLLWLLMSRAPRTRWIIAAGLAGQAATACLLFHVFPRGVLEISLSVLVLSVATAVTGRLVERRRLGPAKQTRVGVATHLLAGWSLLALLCGGGIARPGPFFPETDGVLPLPEGLHATVRPTHDADCGSGSCTRTITVTGRPGQRGDDLYDELKRHLEKRGWGSGCRPVGWLLDRSTACVELFVAGNEVTIDLSGNRGGR

SEQ ID NO: 15514 - protein, 314 aa, Actinoplanes utahensis
MPRWPDIGVPGIVARAGRADIRVAPPDDDHQTGAVSSNPHDGEPSSAAPVWSGPPAMYPAHPAAAFPPGPPGSWPPGLPSYAVAHPPRRSSRTAWIIGSAVVAMLLVVCGGIGAVAYTVRDHQPKRTVAVGEPTVSPGAEDDPEPAPGPTHPGDLAQYLIPAPKGSRKWPTAPADQALADSAAMSKLVAKPAAFQAVLDRYEFRRGFARRWIDGRSLIVDVRAFQFEGTGNARYFADFQQASLRFAGYGEPVPVAGADDTSAQVQPKKDKIGRIRSSGLVVRADMVVMIDTYALPPNDPKALDALLLQESRLLP

SEQ ID NO: 15515 - protein, 306 aa, Actinoplanes utahensis
MATPPRSKADQRFELFLILLLWLFVGYLYLFVGPGTFFTNLVDGGGGDQGGNGNVQEDVQRRRAAAEAALSQGTASAEYRKAVKVGETVEVRLTICGAAAKDCKDSPSATSHDPDHAVVIAPTKTGGNIEVTLVSPDKEGLPEDLSGNGTKFVPANGTKRWAWSLKAERPGTYKLTARVIIHWGETEAELDTTEVPPITVEVEDTFSAWTARWAKRAGDFMNSVGGALAAQFAAVVGFLVYRHSKRNTPATAAAQALPTVPPRPAPSTAQPQPQPMAPRASGATRRSPPKPRQPVATTSPDRVRKR

SEQ ID NO: 15516 - protein, 301 aa, Actinoplanes utahensis
MDRSVGQPRRRVAAGARGRRRRDRADTMTAETQPMPHTVGSLAADLRDLGLSTGDTVLVHASTRSLGFVAGRVQAVVRALLEVVGPGGTLAVPTHTPFNSDPAGWRNPPVPPRWWPVIREQSPGFDPRCTPSQHMGVLAETVRTWPGAVRSGHPSVSFAAVGDRARAIVGGHRLDQPLGENSPVGALYRAHGKVLLLGCGHDRNTSLHLAESRRPQAPMMDYGAAVADGEGGSRWVTWTAPVTDASDFPVIGAAYEAVGAIAVGPVGSAVARLMPQRDVVDFATSWMEDHRPPKTACRMST

SEQ ID NO: 15517 - protein, 248 aa, Actinoplanes utahensis
MGRGEKTREERIVRALRQPPEELEVRGARRWRGVDEQWKSWLRGSATALELYTRRQEADEYRHLLGDDAYRDQLIEVLSRAVPRDCAAAGFGCAQRIDRPCRQPAVCARDRPCHAYYLEHGTGHVWIDFSPAGRHRAVLWWDRANAGRLWVDGQPVGDGIVLDSVGRWVDDRFYTVQAAGPDDHPAQEWEMGGLGRRIRSLLLYDAGHASARLLVPAAGESWTDPWVSRDGGSLRVHADGDDAIGRTP

SEQ ID NO: 15518 - protein, 1677 aa, Actinoplanes utahensis
MPRPSDWWVLDLDADPTPGEPANLVTTGNRLLDFADDAHRAQRAVDSLQGDGAVLTWIGQSGDAFREQFGELPAQLRKVYDSHRMAGDALHAFAPRLEAAQAMADRALADGRAAREQLTGLTGQLQLAQGDVTAIGQQATALQQHTDPDPEQVKQAIRDSEAAKQRLADVQGRVASGQQALNAAKSLAEQARQLRDGAAQECKREIAAASDAGIQPRSFWQKLGEFLKGLWDVVCEVAKWVALVAGIIAMIIGGPLAWIALAAGAVLLVKAIVDFAQGKGSITDLLFAVLGIIPGVRGLTSLSRLSALYKAGGLKAIAQAALTSMKNTVRGLATTVTTAARGVVDVVKTGFSKLTGKINKIPVTTSKRTFEIPACGDPVDVSTGRVFLPETDLDLPGSPPLLLERTHRSDYRSGRLFGVSWASTLDQRIVVESDAVHMLAADGTLLTYPVPGAEGPVVPGHGRSLPLRRSGDGFLVTDPATGRSLLFAAPVADPEPDLVAPLLPREVLPESAGTVPSRTAELVAIVDREGGRIEVLRDGRGAPVEVRHGDGRRIAVTTEDGQITALHLVPATGGEPVLLRTFGYADGHLVTVAGPAGQTMRFGYDGDGRMIRWDDSNGQWYAYTYDADGRCVLGEGRDGYFGYRFDYDPDQRRTSATDSLGHTTVYQLNEDLQVVAETDPLGNTTRSEWDSQHRLLSRTDPLGRTTRFLYDADGGLEALLRPDGSSAKVVHRGGRIAAVTVTGDDGRLCRRDYGRAEAPDPTVDPLGAGPRPAERHRAGTTAPARASDPASPRMLVGGAGPAVSVEARDGFGRISALGDTTGRRIVQGWTVDGQPAWRENADGDRRQWRYDAEGNAIAHTDELGRTTRTEYGPFDLPVATVTPSGARTTYDYDTELRLIRVTNPAGLQWHYRYDPAGRLIEEADFDGRLSRYTRDPAGQLTRLVNAAGESFAFEYDVLGNLIRRTAVSPTETRTTTFRYDAVGHLVEAIGPDAVLEITRDAFGRVTAESINGRAITHAYDDSSRTVTRETPAGVGTLWSFDPDGFPIGIRMAGHEVALFHDAGGRPVAERLDESVTVVRQFDAGDRLVRQRLSDGAGAEVERAFGYREDGSLTLVDDSREGVTVFRLDDEGRVTAVDGPGRREDYRYDAAGEVVEASASVAGATVPGDRRYQGTQLVEAGGIEYRYDPAGRLVQRRDHGRVWTFRWDADGRLHGVITPDGGRWRYRYDPLGRRIATQRLTDGPADAPLDGPVLNQTDFAWDGPVLVEESDATGRTVTWQHDLDGSRPLVQVDGDRLHLLICDPNGAPTDLVAADGTVIRGSAPSLWGHHAGAGTPLRFPGQYADAETGLYYNLHRYYDPRTGRYLSPDPLGLSAGPSPVRYVDDPLLQNDPLGLSPRSCTIGKRPRYDDDAPTELDDLLNDPEMLLAGSALKKFKISAPPKTKFPTPPGNLLIGDMKTALAKYDSDFANASLAKFHGPQDQSAVLSDVFNIGSKTPKLEGWSVEWLNKFERTGGVSDYLKNADVENSWVRGHLLNEDFGFTGHTHNFAPMTTMGNNAFKNGFEQRVKDAFVRMDQLQRLHPQKFDQLGSTFTVDIRVTPSREGLFDGVPGVDVAELAIPKHIRVEAQYMIDGKPLPDSVLKDLNSTIWKERPVKPLPSNNTMNPVTGEWDPPVPTKF

SEQ ID NO: 15519 - protein, 100 aa, Actinoplanes utahensis
MASSDQLKVDLTGLEDLAGTLDRIRDGLNSTGRWILQFTGDLGGDDVDDALEDFESHWSDGRSRVEKNCERLAKSAKQAVEHFRKADDELTKELQEQVKS

SEQ ID NO: 15520 - protein, 203 aa, Actinoplanes utahensis
MTDPTGFAITVPDSWFEIDVHPDTRNSAISSLVNERVRSVPELNPHRSALTRALRGVARTAHANGAAYCGAMVQGFDEALLTASVTVTIVRAPGEEVEASAVAAQLRPLPRSGADGPWREVVQAELPGIGGVPRTRGVTDVVLPEGEGWIRSVTMQTFVPFPGVRSDRIAVITGSSPILPLAEDLLDLFDAITSTFRFISPDS

SEQ ID NO: 15521 - protein, 98 aa, Actinoplanes utahensis
MANVNVTYGEMQNAANRLTRGKDEVLDKLNELRRMVNELVNGGYVTDSSSKQFEQSYDEFNQGATKMADGLEGMGKYLTAAADAFKQADEELAKALKS

SEQ ID NO: 15522 - protein, 1445 aa, Actinoplanes utahensis
MRFFLTVVDPRTSEHADVAVTADAGNRIGDLARVLQTLMRDAADRTAGALYLSGRPLDPALTLTESPLREGAVVGLDAPVDGSITEIPGLLEVRVTGGPAIGATHPLGAGAGDVGSGDDCWVSVPDPGLATVAARLTVDLSGDCWIEPLAGTILEIEREPVEARVRWSPGEQVTLGSTILELADYVLPDAALQMSADDVTIDYNRPPRILPVPRQTRFRLPAPPQEASRSRLPWLMALLPLAAALALVMITGNTSTLFLALLSPLSMLGNHLVNRRNGRRSYTEQMAEHRTRRAGIEADIREAVRLERRERRHRYPDPAAVAGIATGPRHRLWERRRRDTDYLRLRVGSAVQPSEVTVEDLALEEHRRSSRWSSGDVPVTVPLRECGVVGVAGADGTARALGRWAVVQAAVLHSPDDLHVVVLTEPTGRECWDWARWLPHARPPGASGPAVLIGTDADSVSRRVAELLEMCVHRASVRSEAGEVPAGEPDVLVVLDGSRRLRSLPGVVQLLRAGPAVGIHALCLDDDRRLLPAECQAVVEVTGGGLRVTQAGSDEIAGVRPDFLDPGWCARVARALAPLRDVSDDDEDAVLPASSRLLQVLALEPPAADTILARWRMGGRSTAVVVGESYDGPFEIDLRRDGPHGLIAGTTGAGKSELLQTVVASLAVANRPDAMTFVLVDYKGGSAFGDCVRLPHTVGMVTDLDEHLVRRALESLGAELRRREHLLAAAGAKDIDDYVRAADRDPGRAPLPRLLIVIDEFASMVRDLPDFVTGLVNIAQRGRSLGIHLLLATQRPGGVVSPEIRANTNLRIALRVTDTSESQDVINAPDAARISKSTPGRAYVRLGHASLVPFQAARVGGRRSGRRSADLPDPSVRPLGWADLGRIPEDGPVERRDDRDDVTDLQVLVAAISAAAEAGGIPPQHSPWLPALPESLGVETLRADAGAPYGVDDLPAEQARHTAVVELERFGHLVVAGAPRTGRSQVLRTIAGSLAGTYSTADLHLYGLDCGNGALLAAAELPHCGAVVTRVQVERAVRLIRRLDEEIRRRQAVLAAGGFANLTEQRAAATADGPLAHIVLLLDSWEGFLSSLGELDAGALTDILFRFLREGASCGVHLIVAGDRSVLTGRIATLTEEKIVLRMPDPGDMSLAGISPRDVPQRMAPGRALRAGSGVETQIALLPGEASGPGQAAALVEIGRRTRERDAPVPAAARPFRLGELPAQIAYAEVAALRPAEAGAGWLLFGVGGDQLTAFGPDLAEGVPAFAVGGPPKSGRSTALVAMARSALDAGQQVIILAPRTSPLRDLAGRPGVVAAFTGPDVDAAAFTAALDATTGRALIAVDDAEALRDVAASTELRTILRGGDPRPLGIVYAGDPEDLSAGFSGWLVDARKSRRGALLSPQNRTDGDLVGVRLPRTAVGQPVQPGRALLYLGDAEPTVVQVPR

SEQ ID NO: 15523 - protein, 139 aa, Actinoplanes utahensis
MRSRALPTPSTLPLLLVAAVLGLTGVVAAEQPVRPPAHPVAYAAQESVKYYVVRKSYKGEPEFLYEIAERFLGNGDRYAEIFRLNQGRLQPDGRAMTKPEEVGAGWILQLPEDAKGKGIVVGPLPVVSAPAAASAGPAS

SEQ ID NO: 15524 - protein, 304 aa, Actinoplanes utahensis
MGGGLLLAGAVAAGLLLRRRRAAGGTVAGDTAPASPLPRAGAIPAPSARLKRTPAPVLVSQVDAAANWAVDRALRVVATACHQAGRPLPLLYAVMIDAERMVLRLAVPDDRPPAPWTVLENGRAWEAPLRDLQAAPVDLAVPVPTLHLVTIGTADRTRVLLDLGQCHGLISLTGDKAAIRALALMWATELATNSWSAESGVLTVGLGDAPGDAGRIRAADGVRAALDLASASGTPSALFLAAPPSGRDAAALRTLIASPESGSAAVILGSVADARWTFTLQPDGRLDTGAVGIVVHAPLTTARG

SEQ ID NO: 15525 - protein, 201 aa, Actinoplanes utahensis
MATPHRTRTAGRRDGAETRALVRRIALRLFTEQGYEATSLRQIADELGINKASLYYYFDSKEAILQSLFDERGVEAEQLVTWLREQPRTPALLTTAVLRWVDSFTAEKLQGIRFMSANPLLARTLTSGPDGNRIGASLNHFVDELTTLLPDPSPQNVLLLRMAVLSINAAVQAAPSTDPGDEVVIAVARRAARAALSEITN

SEQ ID NO: 15526 - protein, 155 aa, Actinoplanes utahensis
MSEYAVIREYPFPVAEVWHVLTDPEQVAQWTTSGQGGRPEDFAPVPGTRFRFVGKPTMGWAGIVHCEVISVTAPHSLHYTWRGDEDAGDVTDVTYQLQEITGGTRFTWHHTGFTGVGGFAMSRLLGSVRKKMLTEGIPPVLEAYHRIQQRTNPDT

SEQ ID NO: 15527 - protein, 63 aa, Actinoplanes utahensis
MTAIVKSADLPSGTTVHDETLDRWYVKRLVGMFPWRASNGEKLTDFEVDKFLRSGRIVITYQD

SEQ ID NO: 15528 - protein, 284 aa, Actinoplanes utahensis
MSPVRHLWQMYEPLHAVTYFAPQARVAFEGAGLRGYWRGYFAGRAAPLGAVSAAPVTALFYSFAPAMVARAVPEVWQRVSPEQALAARLDGAVEALRAVLPPEPQRWAEAAELLEIAARAAVTDGRALGAANAALPQPGDTLARLWRAATVLREHRGDGHIAALVDAEITGCQALVLRSALFGGREQLQPNRGWTDSEWDAAARALAQRGWLDREGRPTERGAAAHRGVEARTDQLAAQPWTALSPADQSRLAHLVTPLTVAVAAVVPYPNPMGVPRAGGSFPR

SEQ ID NO: 15529 - protein, 605 aa, Actinoplanes utahensis
MTTSGPSVCPESSWPRGGRAHRSGRTGRWVDSAKARTARCRSCTSLSATDRRTPDAMPLSSRPAAAVLATASAVAATLIAATPAHAATVTDTSTTSTTLAAPQSMAAAGGRLFVSDGNTVAVLGTDGVTQKSVTGMFGARDVLASPSGDRVYVALSQAGAVAVLDTATLTEVARYTTGQCPVHLAFAGSRLFYGAGCDQWGGSLGSVDAATGTDPQTVTTARMYSAPLLDGAGNTLVAGVGGISSGPLSTYRVDGATVTPLAQKDTGGFLARVSAGPDGTKVATASRSPYHLTQYDAATLAVAGSFDTGASPTDVAYSHRGAMIGGGVDSGSGPDGNIVAFDVAAGTQVLAGNAHPKAAYNRPAPVAGTLTWSADDTRLYAILDDFTGRAEQPHVYYLARGFETVAAPAATTTKLALVQPAKAGAKVRATATVAGHPGVPVRFVRTSPAGALTMTATTNAGGVATVDIPAPAGGTVTAYYDGDDSNKPSSAKAAYKTVTIAGVRLSGQYKTVKKVAYYHDKKDVVIKVAVSSPVAGRKITIVLQGKAGSTWRTVQAKDFSLDASGVYYIGLVSATRKVQFRVMVKFAGDAYGKPSSATGGAMTIG

SEQ ID NO: 15530 - protein, 269 aa, Actinoplanes utahensis
MTPNLDAPVLGGPREASIPVSGDGRLWAERVGTGSPVVLLHGAGMDSRLWERIVPELARYHDVVRYDARGLGRSTPPNKPFNDVDDLRAVLDYFGLRRAALVGLSMGGESALDFALTHPARVAALALVGASVSGHRWPQEPDLSAYATARRERDVSALAELELSIWAGMGPTAPGWELIDAMVTHNAARRIVSEQQCVTGQNAEAHLADIAAPTLVVHGDRDHPEIGVIARLLAARIPDTHAVTIPNADHYLPLRTPEALTEVLLEHLP

SEQ ID NO: 15531 - protein, 440 aa, Actinoplanes utahensis
MRAARLRRAVRVHRGGGGGGPGRPGHAGRIEPGRWHGGGVRRRGPGRDQRRPGRLRPPRPGRRPAGGRRDLDGEPAGPGPPGAHRAGRRPGRIDLRPPGARLPGPARGQCGDLRPTPGRGRHRRRRPGHPSLRGARAHPRARVMRKESAVPDATAGRPRRVGLVLARASRVLGEEPYYHEFIEGLERLLIPAGISVLVKVVTDHAAEIATYERWSAEHRVDGVIMVDLSPGDHRVDLVRRLGLPAVVIGDPSTADGLPTVWTDDAGSAREAVRFLADRGHTVIGHVSGPLTLAHTQLRLGGFRAEAAARGIILTSAEGDFSHESGRAATARLLSAGAEVPTAIVYDNDVMALSGLVAITERGLGVPADVSVVAWDDSVQCQLAGPALSAMSHDVGRIGEIAANAILDAMRDISATQVYEAPQAHIVDRDSTGRPPLLSAR

SEQ ID NO: 15532 - protein, 61 aa, Actinoplanes utahensis
MYVLGGLLRDRGATDEAEHWLRRSDQVDDDDTMRRLRGTLRNDGVRPLRDLHTEGDLHPAG

SEQ ID NO: 15533 - protein, 287 aa, Actinoplanes utahensis
MAVVSRVPWRRWLRPADQPPANPVKAEAWHRRAIAADPARTTSMVELADLLWKRSDTAEAEIWFRRAVEAGHDYAMDRLGDLYLSRGDKVHAEAWFRRAVEAGNNSAMCSLGDLLLSRGDEVSAEAWFRRAVEAGNDFAMCSLGDLHLSRGAHDEAEHWFRCATEADNDYAMYKLGDLLLSRGDEVSAEAWFRRAVEAGNDFAMCSLGDLHLSRGDDDEAEHWFRRAAEADNDYAMYKLGDFLCDHGETNEAERWFRRAAEAGNDSAMCSLGDLLCDRGATVEAEAS

SEQ ID NO: 15534 - protein, 960 aa, Actinoplanes utahensis
MPEIYPPRSTVSDGRTSAASARCPVAVPDHAVMAATDPSATARPVVRVLLWTVLTIAVAVLAALAGALLTSFAAPASRLAVALLRYDASGVRAASDAWLAAPDGSVRLDVTVTPGRVGGGSRYFDVDATFTFPGADHPVVSLLRSGADQQQIPALLGSAAVRFTYTAHWEDPVVTVRPGAATVRLHGSVLVPVRDRTTMAVPATMFCGKFRSRTVVVNTGRLVPRRLTAEPAGGDCPTGAWDEQTAGSVTFHGLGGAHLDLEQPSGPADAAGTRPRPLFGLPRQITVALRNLWFGLLLLLPILMMWRSMRGRAWPGELPARVVHVFGSMTAFGVLACAGSATQSVVSEMLFHWSLTGHPWPTSLYAPYELVPLAMVACTAVLWRSLALWPVLTVRHPRARRFWAMIFVAFVVLAVPASAMLTAGASPQSEAVTVPATRPAAIGGVPPVAEPSPLHWLTGTAAGYAITLLLVCLLLVTASAALAWSIRACGHTVRTAAATAAVLLALLYLTPFGSRIDTVSTVVQGAVSIAAGVAVWTAFERILRHAVTADPPSWWLGLHARLRPWRSLRLLAAVALSVPVVVYGDEGPRFSFYDTLSLSVSIAGTLRAVAVLLLVLLMWHFGRAVPDGGTAVGTRGQLRAVAALLAVTGLLSPTATTAGLPLAFAFGLLAIHRWLLPPRPVPDLSPPVGPDQEFVARAEVGELTRTAVRARVTESLVRDLRRAVADGHPDAAVQDARAERVADLAGAPCRSATVVWSALSSYRGLTPWRLALTLGLLATLVGLPWSLIDLSTVLATLSSGGPFRLVDAAGGILVVARFTIAGLVLGIAYPMVRGRTGLGKGLSLFVTMTVPALIITLLPDPTRASALAAAGLQTLQWLAFGLVMGLATDLLTLRRFGYGWAHLRELHRMNVLTASVSTMLVSVVTATVTAVGTGAAAVFVQRVLPPPPAATQPQTSGNTP

SEQ ID NO: 15535 - protein, 1093 aa, Actinoplanes utahensis
MSEQWRVGAVVLGRYEVKGVHEGGAMGLVYRVRHRQWNTDLAVKVPRPAVLNQPAFRGQFVAEAETWVGLGIHPHVCTCHYVSTEDGVPRVFAEYVDGGSLRDWIDDGRLYEGGPADVVARGLDVAIQVCWGLDHAHTNRLIHQDVKPGNVLLDADGTVKVTDFGLARAAASVPPAGPGPVDGTLMATTGGLTPAYASPEQIAGAKLTRRTDVFSFAALLLEMLTGDRTWTFGPMAAAALAEYVAAGRMPARLGGLLTRCLQEDPQRRPRDMAAVAAELIDIYRTMLGRPYPRPVPRIAGLRADELTNRGLSLLDLGRTAEAEAAFAEALAADPQHLEATYNAGLLRWRQGQLSDTALLTSLDTVRATTGDPWTARYLTALVHVERGDLESAEALLADAGDDPDVRAARDLLRAGAVTASGAHAVFDGHERAVLCVAVAADRHVAVTGDEVGTLRVWDFDEPMLRYAVKAHDHAILAAALSADAKVVASVDADGTVRVRDLERGWRPRPAQRTLTGHTDKPSKVAISHDGRRVVTNDGPQIRVWDAGTGRCLRVLTGHPGRVVIVAVTADGRRVMSVDAGRVMRHWDLDTGVCLHELPAPDWPGHGAVSADGRLGVAASTLSGAHLWDLRAGRLVRTVQAHSDTQVLFRHAPVALSADGSRMITSGLHRTFRVWETATGRCLRTYTAHEAEVWAAGLTRDGRFAATADRDGVLYWWRLPDPRPSPFRLCRPRTHVELSGLQIRVEALLAKADKELAAGNRPAALALLREARAIPAHEREPRVMDAWRRLGEHTTRSGIRAVWPVRTLAEDAGITRGVSLSADGTLGLTASDNAVRFWRTDGSGAYAVHDPGDSPGTASLSADATVGVTGGLRLHIWDARTGELRRSFGGHTHYKVLSIQVDAAARRVVSGGGDHAVRLWDLEIYKQIRAFTGHRTRVTSVRFDPGETRIVSAGADGQVRLWDVASGECLQVLTGHRGCVNTAVLTPDGHTLLTGGEDGTIRCWDAATGECRWAVQADGDWVNDLAPTSDSRFAASAGYDATIRFWDLTTGACLQVVEGHTYPVWSVSLSADDRYLLSGSHDQSIRLWEVDWDL

SEQ ID NO: 15536 - protein, 241 aa, Actinoplanes utahensis
MIVEGLGWVARRRVAVLVTAVLLAVAQQVSLPAVHSRPLDLTIRMVPSTALILGAALAVRVFPPAKLVARPAVPALDTPASPALVLMAASYTSFAALLLTTLIRTVETVSDVWFAALPVLIIGANLAAVGRLMLTRSGVRLTPDGIEDRRMYGDLFVPWAALTSPDPAHVTGRRQVGLAIARPDLVRVRGWRVGPRTLLPAVGVDPDVLARTINEYATIPDARSTIGSAMPLAGSATTAVA

SEQ ID NO: 15537 - protein, 2383 aa, Actinoplanes utahensis
MSSDIAIPSSERWRCGHFARPAGFRRYHRCLWCVHAARTRSRPDPAPECWTGRPDRAVTEPEAPSARRFADELHRLYTAAGSPEYRILIRQAGVQRPAIRLSDSSLSDWLTGKSVPTSAAAVKFVVTFLQDLVAKRTGQRPPPVEDWLRLHRQAQQDRRAQRGGRPGKRATPRAAAPIPAAVIGLLRLMRLYAEEHPYVQQPGQHLQALSTVYVSQSVASPVEAVRQVWDRELDEVAMVEEDRRVTRLAQPFDEVFSEYDHFVIAGAAGLGKSTLGRFLVGDLIGTMLDGRTSSLPTAGLIPVMLPARVLARHIGRPWAEALHEAVTAEYGALEGVSADTFQRPIAGRNWLVVIDALDEIPDQADRDRLLKVLSTRMATPEPARLLVTSRPLVPGEIAQLQGPRVGFFELQPFDATALEMFAQRHFNPDGTAGGAAEAAEFLSQVRLAGLEQVLTVPLLATVAAQVFTDRRRDQPLPSNRYELYEAYIAHLATRNASAAEVFGAAADPAWCAWLDAQRTTLLETLAAEYTRSETPLAEVAISYVHEHGPRLTMLPVGGESLLGNWLSRAGLLGWHGVRLRFQHQTFAEHLAATARARALPGRFAPAEPVWRELIRQFLLDDESAERTLAHYLHLHRSDSGLIGYLQARSQAEREKAGVLILQGTPRTDAELAAFLDTTEGQIFADVDLDLRPASGLTVHPAVRERMYTWLRDERTPARIKLAIIDIMRERSPQVRHEGARTLEGLLEDPGQPGEIRSGAAEVLAKLGAPYASMAVAALLRIAANRDLSGNCRTAAATALASIGDEHRTAAADLLHQVAEDAGVEGWYRRQAAENLARLGSAGRNRAADLLSRLATDTALDPQARRSAAESLAALGGDHRRRAMVALRLSASSFGSLYSDDRRLWLAAVSLLEADGRNRAAQLLQEVCEDPWVAGHLRLNAARELASLGGSARRSAARSMRDMAFSTQLGVLRTMAAEALAALGPAYREWSLEALTAVVGDPAVSFSRRRAARLLARHEGAAREMAAQCLLEIASAATTDLNDRAQAALEAANLDEQRRTQVRTRFREWLADPTITPASRILAAVILVSLEPDSATTEADTLYHLAAVADGHHVARLAAAHALAQLAGHNLDRAARLLLMAATDPLSPDFSRRAAAVRLAEVAETHRSQAAELLREMISTAGDPSDYGDSVSDLAGLGDAYRAEASALLLQCLTGPWPAEGDLQSIVWRLRSFSQNSAVKAAETVAEILKDPLVGALYLFSDDIVILERFRPGLARIVFDHFRRYGELEVIGLCRAAEDLVQADEKYRDQAVKVLRSAGEEVQAEPDRSLLISFAESLESRDQGIFATALVQVLESRDVSPSLLPEAARRLEQEESHRQKLIDLCRKWCADPRLDEWWRLWVMERLEKSDAPMVAQIARELWTNPTLPVATRLRAVRCLRDPSLTKDHSLTILAGYERVPLAVNERSAVASALCDLGPDHTDRAADIFAGLLTDPTVPLHDRLSAGQSLAELGGTRSALAGALAERLVADEHAGPLDQTVGAAFLAWLRPETHVLARQVLTGMAAGPHAEHRLTIARELGTLRGGAAAAQRALAEIVADPATDDPTRGEALQSLTGWVTGQEHACRLAGALASDPLINATVRIAAATLLARLQPDRRVQAITELSRIVVAVTAGPERVRAAHLVARADHPRRPQIAEILLELASDPAQDDETRREAATLVTRFGDQAADRAGDLLALIAGDPGAWPSTRLDAAQALLRIHGQRRRAVDLLRGIADDPHLDDEDRVPVLAELVKVDSGRRASAIAMFATLAADSEVPAGGRLAAARELVSLGGAGIDEATTTLRRLAVDPVAPAASRRGAAVSLYRQGSAHRAEACRLLRELAADGTVAADERIRAIQDLAQREPASTDLHRDMLRDLIRERGIAAADRGQAAETLAGFGESARADAARLLADEADRAAVPDRFVLIGHLAGLGSAARGLAAERLRAIALPADHPGRLHQAMATALLVGIEGGSDGRAARLLTEVAADAANSPNDRLWAAAYLVRLGPAHIEAAAELLDAVTADANLRLWERREAARMAARLGPEHRRRAAAGLAILMRDPDADVWERADCAVAYEALDPAHRPATIQVLEQLAGHPAVAADQVRYVVDRLLPYGPPARPAALAALDRVAADRAADVRERAGAAAILVRLGGTTAGLQLLRDLAADGELSGCEQAMAHAILAEVRPARREAAARALTAVAHDPQSPVEHRRTAATALTTLSGRTRRDGLDVLRSLVLNRIDDAPTALAAATLAGWDARLRPIAVAAADRLVTGPLSPTETLAVAEALARLAADPSRGARLLHRLARDPAITPGDRRRAYAGWIAWSPAGTTTGPARLPRPVPPPR

SEQ ID NO: 15538 - protein, 443 aa, Actinoplanes utahensis
MISPETGRTGEMAASPPFAGGNRDVTAHRSRAGSPASGRGPADRGGKSRLCRHRHRRHDRGALQPRPRTTPCRPVRSRTAPASDRGRWIRHARELTGTAPWPNGVARQSAPVQNGPVQVRALDPHDPEAGPWHAAFRAGLVAGREQPTVAGAESTLTSLRTIADNAVLDRRAFGAWDGGECLGGVIVDLPRVANTHTVGFELAVAPRHRGRGAGTALWEAAVAVAREHGRRVVSTELPVPLTASLAQHPGGRFALARGFAGKLQERRYLLGLPAEPVAAEVPAGYRLHSWTGPVPAGSAADFAAMCTLMERDVPTGDRDHDPVVVTAGQVLRGDERLATGGWGLVTTLLGAPDGRPGGYTRIFVNADRRHAQQDDTFVLRAHRGRRLGAVLKSANLARLTEHFPGVRLLHSWTADDNGAMIATNRRFGFRPVEILHTMEGPVP

SEQ ID NO: 15539 - protein, 268 aa, Actinoplanes utahensis
MPGRFLAFRRPRPAARPAVNSKSSISVYDVTHTLTGRVVAALTVAALVTLGAAPTPANAAGHHGVSCAYTPTPDDPAARPVSPPRNTSHTPDHGTVEVVLRTNLGPIPLRLDRAAAPCTVQSFLHLVRHRFYDRTICHRLTAYPTLSVLQCGDPTGTGEGGPGYRFADELPVNLPPAPTDPTGVRRLYARGVLAMANAGPDTNGSQFFLVYADSALRPNYTVFGSVRPAGLTTLDRVAAGGITPTADDPAPVDGAPALRTEIRRATVC

SEQ ID NO: 15540 - protein, 1068 aa, Actinoplanes utahensis
MPFDGFISYSHAADGRLAPAVQRGLHRLAKPWHRRRALWIFRDQTGLAVTPKLWTSIQDALDGSTHFVLMASPEAAASPWVNREIEHWLATKSADQILPVVTDGEWCWDGTARDFTEDSTAVPAALRGVFEEEPLYLDLRWARDDLHLTLQHVRFRDAIAQLAAPMHGVSKDELEGEDVRQHRRARRLSTVAAAVLVLLTVVASVTSVVAVRNAERANTSAAEAHRQQQVAAQQRTNAERATEESVRQQQNAQVQENRARDAKAETERQEKLAAEAAANAKREQDAAARYRITAQFQQKLADQAASRAKDQKALAEQYRDLADQADQERKKQEKLAQQAQQEAAKQRAEADRLQRMEVSRRLMIRARELIADDPRQALRVGAAAVALSPDASGREQLGHLVMSTHYAGTLTDVTSVATLAGQMTATTGATGRVSLWNAANPAKPVRVGSLPGTAAATTVVGRPDRPTVAVFDGSPTATVWNVTDPAHPSRVATLTDPAGIVAMSISPDGHTVSTSNLAGDSRLWDIRDATPTALTTLTGVYPLKFSPDGRTGVTSGASVVIWDLTDPAHPVRGVTLDPALADLAGAAVDFNPRVPALAVESKVANVMFFNLSDPAKPVMSGSTPYSYDDARPTAMGFSPDGSLFTLTNSDGETGLWSFDTSSQGMSVNSKLAALNSPDGGVRSLGFSSDGATLTTASAHHVATMWSTRGRYPSSPVGSMERPFGGTLVGLAYAPAAGPLFSAGYAGTAVPWDVTDRTHPVRGATFPLLNGTVEGLVLSPDGRTLVAAGSDTSVPLVDVSHPEAPVPLSVIKEEGGAITALAFSPDGHTLAIGHSEGRASLWNVTDRRRPVLLRAITMRQYVWALAFSPDGHTMAAGEGSNISLWEVTDPAAAEQLSSVVLKEYILYHATAITFSPDSRLLATGTTAHTVIMWDVADPARPRQSAVLGGHTWEITNVMFSPDGQTVASVSSDGLTMLWDVADAVRPVPFAFLKPAAPEYLAAAFSPDGRTIVVGGSFGKAPQHATLWDTGVPKSLALDPVGNACEISGRGLNRDEWSRYAPELDYRPTC

SEQ ID NO: 15541 - protein, 1009 aa, Actinoplanes utahensis
MAAEFGVLGVVEARIDGVSVDLGHARQRCVLGVLLVEAGRPVSVDQLVDRVWGRQAPQRAAGALYSYLSRLRRAVAGAPEVEIRREPGGYLLTVEPQTVDLHRFRSLMAQGRAAGADRVAAGLFTQALGLWRGDPFAGLDTPWLDGMRRTLLGERFVAELDRTDVLLRLGRHAELLPVLSAAVAEHPLDERLAGQFMVTLYRCGRQADADEQYRRIRRALADELGSDPGVALRRLHEQILTADPALVGPVEQAIDRLMERPGEKAADRPGEKEPPVPAQLPADVRAFTGRTGELAALDALLVSPGGAEPPLTVALVSGTAGVGKSALAVRWAHRVRDAFPDGQLYINLRGYDAEQPVAVADALAGFLTALGVRGPEIPPGIEERAARYRSELTGRRMLVLLDNASSVEQVRPLLPGTGSCLVLVTSRDSLPGMVAVHGAQRVNLDLLPVPDALRLLRKLVGVRVDQEPSAAESLAAACARLPLALRIAAELAADRADVPLAELVADLGDHRLRLDLLDAGDPRAEVRAVFSWSYRNLPEAAARLFRLLGLHPGETVHVDAVAALTGTDPVEARRLLAVLVRASLAQAGRGGRYGLHDLLRAYAAELADRHDSEAARRAALTGLFDHYLARSAEAMATLYPDGAGAPGDPDAARDWIEAERPNLAVLCTYGTAHGFHPQTIALAGTLFRYLDAGGPVAEAATITACAVSAARAIGDRDAQARALSHLGRLHRRLGRPHEAATAYRQALSLYAGLGDRAAEAMVQRNLGSVDWLLGDYRAAADHFQRALTLYGELGDGAGQADALVRLGMIDARLGDPLGATQRFEAALQRYASLGDTFSEAYVLSLLARLPHRPASLDRAAARLEQSLGAVRHSGDRTAEAYVLSDLAAVHARQDRLAEAAGHLRRALVLHRRIGDRASEAEALNDLGQVLRAAGDGDEARAQHAQALGLAEEIGDRYEMARAHDGIAAAFLDAGDPDRARPHAERARRLFAELEVPAPAGPAGGQQVGR

SEQ ID NO: 15542 - protein, 259 aa, Actinoplanes utahensis
MRGMETVTSRDGTTIAFDRYGDGPPVVLVGGAFQHRWIDQQTARLGELLAQAGLSALHYDRRGRGDSGDTPPYAVDRELEDIDALLEAAGGSAMLFGMSSGAALALRAAATGRPVERVAVYEPPFRAGADPETTAAVIAAAREGRRADAVRGFMRLTGMPDAMIDQVQQSPGWAGLEAVAPTLAYDLTIMGNGDVPVEVLAAVKVPVLAMDGGASPPWAGEAAAAVASGVADGRRQTLPDQTHGVDPEVLAPALIDFCR

SEQ ID NO: 15543 - protein, 498 aa, Actinoplanes utahensis
MTFRIWPRLAAIAVIGLVLQLVVQQLSHSVGLVAGSIPVALAGFYATVGFVRLARRERGRLLAGWAVGALSAGLLGVAYVLYTMEAIWARTPATPDVAGLLSVGAAAVALVALLLVAPPLSGVVARLTLLIDVATVGGALLVLAWQLALSEVAAALDAPTRLMFLTTAALEIGGAAVALVLMSRSTPTANGYALRLLAGGLGTFAATAIIAVYNRAEGSPWYATGAGAGYLIAALLIALSSRTALPSADSTGRRALSGIWPFIPYVPAIIAVVEVIRVYLRTGTLPPLLMWLLLSAITMAMLRQLLMLVTIRRLMAGLHHQANHDVLTGLPNRAAFQAVADGALASAPDGRCTAVLLLDLDGFKLVNDTLGHAAGDALLVTVAGRFAAALGPGDTAARLGGDEFVVLLTGLAAAEQADESAQRILDAIGMPMTLADRTYRVRASIGIAVGYGGGHDLDQLLQDADAALYRAKNAGKGTFRRYETEAPGETDPAKVAAA

SEQ ID NO: 15544 - protein, 189 aa, Actinoplanes utahensis
MLVIAHDEGLPCCGGLSGHAARRVYNDPVGRDGTSYSQVMLTASKTSVWRGRYQIDADGRPVAVWDPSWWRNGGAFEIDGQRFEVRANGWGTKYRMYDAAGNEVALVERAGRKYWSVQADGRMYEFRRSSFFGNRQELVVGGEPAGEVRRTGAWSGNIEADLPGLPLPLQIFVVGVQIAIWQAQQASSS

SEQ ID NO: 15545 - protein, 128 aa, Actinoplanes utahensis
MPDLDDETIAYAHRMFDLARAGDTGELLDNVAAGLPANLTNDKGDTLLILAAYHQHADTVAGLLRHGADPNRVNDRGQSALSAAVFRQSAQTVRALLAAGADPHGGAPSAVATAEYFKLPDMTALLRG

SEQ ID NO: 15546 - protein, 230 aa, Actinoplanes utahensis
MVVGMLVWERPEPPDRPVPSPLSRQRIVGAAIRLADADGLEAVSLRKVAGALEVGPMRLYGYLATKDELLDLMVDAVHAEIRPAGEDWRAVLRSMAEQTRAAAHRHEWFADLLGGRPQLGPHALARGEAVIAAMGAVTVDDVMPVVEAVNSYVIGAVRREITERRAERASGMDKRQWQVASGPYLMRTFASGRFPALAAVVRDAAHLDADQTFRLGLECMLDGIAARVPK

SEQ ID NO: 15547 - protein, 178 aa, Actinoplanes utahensis
MTISWRRLGQPDFPLLRRWLEQPHVARWWNHETTPEAVERDFGPAARGETPSEDLLAMLDGGPVGLVQRYRIADFPEYIDELAPHVDVPAGSMSIDYLIGDPALIGHGLGPRIITTIVARTWLDRPDATCVIVPVVAANRASWRALEKAGLRRVGAGNLVPDNPIDDPWHFIYRVDRP

SEQ ID NO: 15548 - protein, 164 aa, Actinoplanes utahensis
MSRPLLLLDVDGVLNPHGTTQPPVGYTEHHLFPEDEEPVRINPTHGAWITEASTVLDIAWATSWNDEANQLLAPLLHITPLPVITMPAPPFDPSDKIPLIAAYAQQRPAAWIDDLHTPEARSWAATRTNPTLLITADPTIGLTRDAIDHVIAWAKALDTPLTNP

SEQ ID NO: 15549 - protein, 85 aa, Actinoplanes utahensis
MAFCRHPPTFRRTSIAGTLLARRPTAFAALADPVSRAYYDRRRAQGKRHNAALICLARRRCDVLFAMLRDKVDYQPRPIVAVITG

SEQ ID NO: 15550 - protein, 300 aa, Actinoplanes utahensis
MPCMRADLGTVVITGAAGRIGSVVRRHLRADVRRLVLVDRVPLSVESPVEQTIRLDLADLDAVAAAMAGADAVVHLAGLPDEAPMADLLDSNVLGTYHVLEAARRHRVGRVVLAGSNRVTGFYPVGQVVTPDDPVRPDGFYGVSKVAVEALGRLYADKFGLSVVCLRIGSFEDEPTEARYLATWLSPRDGVGFIRAAITAPDVHFVTAYAVSANTRRFWDTAAGAQIGYQPVDNAETYAARVPGSEATTDSAAVQGGAYASPEYSLRHAVTPPPSGVRGVGAEHAGQSTGEHGDERFRRG

SEQ ID NO: 15551 - protein, 226 aa, Actinoplanes utahensis
MVGQQEPVIWLRPERAAAGRPAERSRAEITAVAVRLADHEGLEAVSMRRVAALLGTGAASLYRYVATRDDLLDLMIDSTAGEYRLSAASGDWQADLLAVAHQARDIMRRHPWLPALVIARPALGPHGIDLLEHVLAVLDGHPAEPARKLRAFALLGGLTALFVQNEVAAADVARQSAYLRHAAAAGDHPYIAAALAAPVGSPPPEPFIAVLTGALTSVLGPDTAHA

SEQ ID NO: 15552 - protein, 313 aa, Actinoplanes utahensis
MFAYTVRKQTERSDMTTQYAINGGVRIAVEELGGAGGAPLLLVMGLGTSRFWWPDGLVTELVRRGFHVAAYDQRDAGQSTRLPAVRRTGPPIAALVRRSTPAYTAEDLTDDAVAVLDTLGWHRAHLFGHSMGGLVAQRIAIRHPGRVLTMTSSAAIPSDVRGLRTLRHLRLAPLVRFARLHHPATPDGDLRLAVAIARILAAPGQDMTERDVREFVTREAAHHVASFRDDEAQSRQTGATWSGGPLHRITAPTLVLHGERDPIVRVGAARAIAAAVPGARLRIIPGAGHFLSRDLWNVYAEEIHAIGGPSACG

SEQ ID NO: 15553 - protein, 341 aa, Actinoplanes utahensis
MRATLMFGAGDVRVETVADPAPQRPTDAVVRVVRSCVCGSDLHPYHSMPAAEQGRQVGHEFLGIVEQTGADVATVKAGDLVVASFSYQDNTCEFCRAGVQTACAHPEAGFFAGAQAELVRVPLADGTLAKLPVPADSELLPSLLTLADVYGTGYHAAKKAQVTPGDTVAVIGDGAVGLLAVLSAKQLGAGQIVLMGRHKARTDLGVEFGATDVVAERGEEGIAKVRELTGGGALKVLEAVGHRPAYDQAVGIVRAGGVISRVGVPQYDEAPVGRASLFGRNITLNGGPAPVRAYVDELLPGILDGSVNPGKVFDRTVSIEEVPAAYRAMDDREVLKALIAF

SEQ ID NO: 15554 - protein, 217 aa, Actinoplanes utahensis
MTSMSVDYIAPHWANAALVTIDLQVDFAEGGAGAIPGTTAVLPAVRRLAAGFRRAGLPIVHMIRLYVPGGADVDPPRRAFVAAGGQLVAPGTAGSALLPGVTGDSGPFALDAAELLAGRAQSVRTAEIVLFKPRWGAFYRTDLEERLREAGVDTVVVAGCNLPNCPRATVFEASERDFRTVLPVDAISQVTAERVTDLARIGVATLTVDEILAGLPS

SEQ ID NO: 15555 - protein, 108 aa, Actinoplanes utahensis
MVRDELVRLREDAEAEAATLAGDLDALFAASRDSNADDEHDPEGATIGFERAQLTALLTAARQRIAEVDDALARVDAGGYGVCEGCGRPIAAERLAVRPFARHCISCA

SEQ ID NO: 15556 - protein, 557 aa, Actinoplanes utahensis
MGMSRRLAALVSSLVLVVGLGCGTSAAVADAPQPETAAPLRFVAYNLCGNMCVADGTGADDAHRTATVVAQAATGGWRADYLFLEEVCRYQYDDIAAKLPAGFTGVYAERLPAGTVISGRKVCKGSAYGEAVFARGTKVGEQILTLTVGAEQEPIKSPCVKSWVQNRLTWACTAHLYWNEAALREGNARKLTDQTRAWEAAGLPVIIGGDFNGQPGTTTTDAFYSPGTQQGSGDMTEVDETDGDHFPSGCTSGHCRSGEPTFHDGRKLDYIFVTSRFFREVVGDALPQDATVSDHRLLRGGAAWADCGALSPGAAGLFRIDAAGLLYHYAGQAGGTLAGACKRGYGWAPSYLTHVARQGTTLVAVDRDGVLWRYPADPANGRYTGGTKVRAGSGFGGTETLLAPGDIDGDGQPDLVVRDRQGTLSRYPGTAAGGYGPPIAIPAAAGVPWSTYDLLFSPGDFARDAADAPDLIGRTADGALWLLRGDGRGGFGPATQIGTDWQIYPAIAAAGDVDGDGNQDFIGRDTTGTLWFYRGDGNGGYAARSQLVTWPDGEPLF

SEQ ID NO: 15557 - protein, 304 aa, Actinoplanes utahensis
MLAAAMMSILVGVAAMAGLTGAATAATATPPGNRANYTVVLMRNAGATSFVRLAEYSLRADGSARADYWAWNSQTPEASVASGFTNEGCGNSCPILTTDGFQNPAQQLFGTWSVSGDDLTISWTSGNPQTERWKFTNQATATRVELASHPTATNGWGWGSRISFGSGLSAQQVLAANTTLSGRYIQNAEGVTTNPTPWGTTSLGLRPGATVKLCSATCISVGNSANKAYLAGSGADRRMYYNHEQFAVHADPCIVHGHLKPALQVLDDNGAFRGLIMVEASLYADLGPTGSTILGIYDLNDFTS

SEQ ID NO: 15558 - protein, 79 aa, Actinoplanes utahensis
MGGNGAMRLGGTVPEPFGPSVPARVPWPRRHRHRDVGAATVLTTYTRERTLIVESRERRERGVVATFPADRQLVKSLRS

SEQ ID NO: 15559 - protein, 963 aa, Actinoplanes utahensis
MRGHHGPQVRLQLLGPLLGWRDDEQVSLGPVRQQVVLAVLALSANRPTGRAELIEAIWGESTPAYAVNLVQKYVSGLRRVLEPVRPGHHPSQVLSWTDAGYLLSLPDGGLDLEEFERGVARARAARVEGDLKAASRSLHEALELWRGPALNGLSSPLLDAERNRLAERRISALEERIEIDLALGEHRDLAEEAGRLVAQHPLRERLWALLMRALYQEGRQGEALAAFREARDHLSSQLGVEPAAELQALHKRILNGDPDLLAPGPRVPQTGAVPASPGPAPLPVRPARPEPRPAQLPHGLPEFVGRRAELDRLDALAASGQSVMIAAITGTAGVGKTSLAVQWAHRISHRFPDGQLYVNLHGFDPSGSVARPAEVLRGLLDALGVGTQQIEGTVDELAARYRSLLAGMRLLLVLDNARNTEQVHPLLPGTPGCMVVVTSRSRLSGLVAAGAVPVTVELPTAEEATELLSRRIGPERVATEPLAAAAVVAACARLPLALALVASRAAPHPRYRLSALAEELRPARADVLDAFIGETESTDARAVLSWSYHQLSAPAARLFRLLGLHPGPDITAPAAASLAGVPARQARRIMAELSGAHMIEEHTPGRFTFHDLLRAYAAEQVEEEESVTERQAATERLLDHYLHSAHAADRTLYPYRTPIVVDPPGPDATVLAFAGPDEALAWFTAEQPVLLNAIAHATGAGFTAYTSRLTWTVTAFLNYQGQFHSWARCLRAALLASRQLGDRAGVAQAHQLLNIACRHLGLIAEADTHAERALHLFDQLGDRSRQGRLLLDIARGLEHRGEYEQALRRATRALCQFHEAGDRMGKADALSWVGWYYSRLGDHDAAMRHCHDALRLHREGNWPGQADTWAILGNAHHHLGHYDEALDSYAQALARWGELGDRYEVAITLQRLGDTQQASGRIDQARSRWEQARTILEELGHPDAVLLQARLDAHGAGGAANER

SEQ ID NO: 15560 - protein, 638 aa, Actinoplanes utahensis
MGTELPLVSKDVPATPVGLAHPDAGQRAQWPVVLVAMPFLETGWPSIQIGLLAAILRQHGYPAQTLHGNLDFAARLGAEYYHLLAGRRARMVADWLFSVEAFGSTAPDPNGKLLDDYAAELAELGGADESTWRDRLLRVRHEDAPAYLDALAADPVFHGARAVGFTTTFQQNTASFALARRLKQRYPGLVTIFGGANFDGEMGPEWVRAVGCIDLAVVGEADAALPRLLDCLVAGASPGAVPGVVHRDGGDVVVTPPAPPLRHLDDQPLPDYTEYFERAGRLGVLPRTGPSPVPIPFETARGCWWGEKHHCTFCGLNGSSMQFRSKSPQRVADELVAQARRYRSFRFHGVDNIVDMAYLSDLFPVLARAGVTLDIFYEVKANLNRSQVRALAQGGVTGIQPGIESLSSNVLRLMNKGVRAAQNVNLLRWAAYYGVGCGWNILWGFPGETEEDYRDQAAVLPHLVHLAPPSSAGRLWIERFSPLFTASPTKTPERAYTYVYPDEVDLRRTAYFFEYDLPGALPEHAYDGVRQGVADWVAAWDGGNRPTLTFWSSPGVIQIYDGRRPGTEGTYTFEGPIADLYTLCSDRPIGAAAAHERLGGRLSPDEIREAFDEFRQRGLMFLDESLALSLALPAGPPR

SEQ ID NO: 15561 - protein, 891 aa, Actinoplanes utahensis
MAAQPADAVGPQPGVVPQGPGDAAQPAQPVLVPQLPARERPPERVRQHGDLPPVPVGVVRLSAVGGVQPGARTHPLQRAGVGDRGDRRRRRLDRRLAGHPDRRRHDPLPRPGHRGRTRPAYSGGLQHAPGRSGHPQHQVPEPDRPDPRRPARPGGGRRWSPELGRDVLRPAPEPADVPVDLGDPLGRAAELPDQQVRQRTVLPVVRRRVLLQRTGDPCPDPRRDAPDQLRRARPAVPRRALHDAVSAEVRRTATLVDPPDVRGRRGHHGRRGRGAGPARPDQRQDRAAALRRGTAGHRVRPADAPDDAGPGRPDRPGQRHGQPLLPGRHRRLGVGRAVSAGLQRADARHRRFADQRAGPPLAGHPRGPAGPPRRADGRLMAERLMIVAPGPTANGDLHLGHLAGPFLAADICTRYARAVGRDVLFGTGIHSTQNYIVTTARRLDEAPEELRERAAGLVRESLATLRVQADGFVTFDDRYVKTVIAFFERLHSLGKLRLRPVRFPYVARTGEYLTDAYVRGSCPVCLADGCAGLCESCGTWVASGDLIDPRSTLDPGDVVELREASVLVLPVEEYRAGLTAYFEKHGPTMRPRLARMMEEMLSRPLPDYPVTLPISWGIEAPFPEVAGQVIYSDAETIAWSMRCTALAAEARGEIPTGEDELWDAGADGRVVYFFGSDATYAFVVVGTAMLLALGGYVLPEQFITNEFYELDSDKFSTSRGHLVTGRELAAEVPRDLIRFYLASTGPEFQRTNFTRSAMDRVTGQRLVEPWNRVARRVNALAGRGPLPVSQASRDRALLMMRRFGGDLAPRRFSISAAAFTLTEQLSRLDRWEAGADDAGDFCHEVEMFLRCAAPILVDLAEQALPDTTIPDRPRATRIMPRSMPLLALSAA

SEQ ID NO: 15562 - protein, 352 aa, Actinoplanes utahensis
MTIVARTRRVLVVGAGVTGLLTAVACARAGYRVTVLDRGGAPDPGAASYDQHRAFRAFIAGDPQATGQLLTARRRWRELEALLGGTLFRRVGVVTSRPRDQVDALAAEATAAGAAVEVVDPGELPHMVLPAGSVGLKEHDAGVLLAARVLRAAARWLAGQDTVQLCPGQTVSTVDTQTGRVRLASGRVLGADLILVAAGAWTRDLVDSPVVLYRQTMVYLRPPDDLRHWWNGAPAAGGLGPDRRAWLVPSGAGTLLKLSTDAVCRVVSTVRPDDPAPRWTQRVLAARIVRDAGRYTVVGVKDCHYAAAAAGGGALLVRAGPTVWSRAACGGSGFSTAPLVADRIVQALSEAL

SEQ ID NO: 15563 - protein, 420 aa, Actinoplanes utahensis
MSDNPQPGVIATLRITPTPVRHLLTGVFINQLGAFVQTFLVLYLAFRGQSAGTAALCLAAYSVGSIFGTMVGGELTHRVGARLTIVTAMAVAGPTVWVIPWVTHTGVVAALMVVVALAGLATQAYRPAAAVMISDLMPEEHQVMAFSMMRTALNLGAALAPLIAAGLILVDWDLLYWFDGATALLYAAFAFFVLPRAVGLTPDSEPETDAAPKATGREVYALLVRDRKFLCYLAAVFLGTIAYTQSTSALPLAIVAEHYPAALYSAVLTVSSLVVILAQLKITTYVTRLPKTVAVGLGHLLDSIGLAVFVLAAWWGGIFIIGVVLSVGGLMIAGPSMFAHPATFHPVVKARYIATMQSVAGLAATIGPLFGVLTWHALGSPFWLLCAFINGIAGVLAVLALRRTAEPVPASATETAGETS

SEQ ID NO: 15564 - protein, 855 aa, Actinoplanes utahensis
MNVQPGTGRPVVVVGYVGVTLAAVARFQPAGSVVYVEEPDVIRKRAVRAHLDGVPFVRDLIAWEYLRPGAADEFFDAHPGLDPASVIPAIEYATPFAARLSERYGLPGAGSGAAAIMRDKIMLREVTRAAGIVNPASAEVAGPDDVAAFLAGRTGPVVLKPANRQASVGTEVIHDTGDVAAAWERCGRQDEGIFVPDRPMDVRMLVEEYVAGDEYSVEMLVRDGVPLFTNVTGKRLYPGPRPVELAHIVPADIPRELAALLGSHTTDVVAATGFGTGAVHCEWIVSQGTPYLVECAGRLPGDGIVDLIEAAYPMDLLRCYYAMMSGADVTAGLPQRATGGAAVHFLTATPGLVEQVSGVEEARAVDGVLLVQVTVEPGQLSPAVRSSWDRAGIVMATGADAGQALRRARTAADLVRIDTRPATDRGTLLVIGSGLKVYREYLIRPIRRRAEEAGLDMVLVNNLRPTWQSEYFDEIVVADVFDTRTMREAVDRIAARRRIVALMCWDEPLVLDAGLIAAELGVPGLSEAGVQGCRDKQRTRAELTAAGLHQPAFGLTHTVEEARATAARIGYPVVLKPRAMGASIGVVLAADESELDDGFRVALSASEVDPGPYRACVIVEQYARGPEISVDGAVHKGEYLPMFVARKQSGEEPYFEETGHLVDAADPLLADRDLMQVLTRAHRALGVEDGITHTELRLTPQGPLIIEVNGRLGGDLIPFLGRTATGIEPGEVLFDVATGQRPHLTATRRMVAGIRFGYPEQDCVLRSITVPDAAPGLVAAAPMAEPGALLRLPPGGYLARHSFVVCAADDTATCLDRLAAAAALVHLTGDPVGPPDGQTPFAMPAGLLDVDSEEL

SEQ ID NO: 15565 - protein, 396 aa, Actinoplanes utahensis
MTPTTLSADDVLDRAKALAPLLRERAAEIEQARTLPADVVELLRGTGVFRMCFGEDWGGPQLTSMQQTQVAEALAYGDASAAWCGIIGANTGLLSNFLERAVAEKIYPTLDTITAGVLAPAGHAERVPGGYRLSGRWSFGSGVNHSDWVMSGAFVFQDGEPYASPDGSNPHESRQFLVPRSDVQVLDNWDTTGLCGSGSSDYTMTDVYVPEEHTLTFDTVKGTPGPLAQPDSFMRSLCGVPLGVARAALDHAREISLRRTDRMTGTAWADSFRVQVTLAECEAEYNAARAGVYTAMTRQWEVLSAGGTLDDLTLDERAASPIAWLHAFRTSRRVVGRLYDLLQAWSINRSSPMDRWLRDTTTMCQNLSAQDAILESAGAYLLGRPPRFRICLGIVR

SEQ ID NO: 15566 - protein, 402 aa, Actinoplanes utahensis
MTTTQVPVISPPRTAAEILDRAKALAPVLRERAAEIEKARTLPADVVELLRGTGVFRMCFGPEREGPGLTSMEQIQIIEALAYGDASAAWCAVIGANSGIYSRFLDPGVARGMFSSIDMVVAGLLQPSGRAERVPGGYRLSGRWSFGSGVNHSDWVMSGAFVFQDGEPYASPDGSNPHESRQFLVPRSDVQVLDNWDTTGLCGSGSSDYTMTDVYVPEEHTLTFDTVKGTPGPLAQPDSFTRTMCGVPLGVARAALDHAREISLRRTDRMTGTAWADSFRVQVTLAECEAEYNAARAGVYTAMTRQWEVLSAGGTLDDLTRWERAACPTSWVHAFRTSRRIVDRLYDLLQAWSINRSSPMDRWLRDTTTMCQHLIAQDRILQSAGAYLLDSRPEFGICLGIV

SEQ ID NO: 15567 - protein, 573 aa, Actinoplanes utahensis
MSSGLITLVNPNKVFPPIAPYGLDVLTTALEQAGFDVDVLDLTFRRDEWKSFLAEYFAERTPLLVGVSVRNTDTVYALEQRPFVGEHKEIITEVMRLSDAPLVCGGIGFSTMPFALVEYFGVDFGVKGPGEQILVDLADAVATGRDPATVPGLIRNTPEGVTRVPPPVLRLPHGLSAPVSPTADGEDRVWQVERSGSYRRRSGQPYKVDNLQHYHGGGLGSILTKNGCTYRCAHCVEPNAKGNRFGRRDVAAVVDEMQSLTEQGVLDLHTTDSEFNLSIAHAKSVLREIVRRKRADSGNPLNDLRLWVYCQPSPFDEEFAGLLAEAGCQGVNVGSDHIRADLLQGWKVTGGGSTYYTFADTERLVRLCHENGLKTMVEALFGMPGETMETMRECVDAFMALDATVTGFSLGLRLFPYIPLGVDLAQQCDGVRTAPGLQSNTATEPIVLKPLAACSGPAEYERQFMFDEHGDFRLVCYLSPGLAEDVTNPSVQWERTVERLWDLVDPAEHHRVMLPTLGGTSEIDNNYADNPFLTSLSQLGYTGAFWSHWRDREAIMREAREAGILPTPEAGRR

SEQ ID NO: 15568 - protein, 138 aa, Actinoplanes utahensis
MTSERSRTVTGAESGGVQVRRQEPDDLARAHGLDLKLLQPWPGVDTPFEGAWCVLRPGDVTDTHSHPEREIFIGMAGRGVLVTASGERHSIVAGDLLTMRPGLEHHVENDSDQDFSYYAIWWDGATAAAFLDRAAQPS

SEQ ID NO: 15569 - protein, 107 aa, Actinoplanes utahensis
MIDYDGRRFRKPGDADGTVATYHQQGDVVWADFSGGEVRRGSITGIRQSDGTLHLGYTMVLNSGEVICGRALNTPIATGDGPLRLRENWERYGPHAATGVSYLEEVG

SEQ ID NO: 15570 - protein, 458 aa, Actinoplanes utahensis
MPTVSAAAWRALETGVRGRVLRPDQSGFRESSTPFNTRHAATVPAAVVRAADVADLRLVLAWARDTALPVVARGGGHSYGGYSTGSGLVIDLSALDEVTVDASTGRVTIQGGVRTAGVYAALEPHGIAFPLGNGASVGVTGLALGGGTAATSRAFGLTADTMVSTTLLTADGRLLTCDATQNADLYWACRGGGGGNFGINVSTTFQAAQVSDVSTFLLLWERAAAEKVLEVMQEVQRRAPREFSARLGVAATAGSDPVVSAIGLHLGPAGELRELLDPVLAVARPVRADIADRTFWQAQSYLLHDTSAEAFAVKTSFVRDPLPADAIEVLLSAVDRWPTSTNPDGGGVALFAYGGAVNDVAPVDTAYVHREGLFLLSMDTSWTDGDDPATVGAGLRWLAGLREAMTPYVTGGAYQNFIDPDLPDWRTAYYGVNYPRLVEIKNQVDPDRVFSFPQAIGT

SEQ ID NO: 15571 - protein, 117 aa, Actinoplanes utahensis
MVSLVGFAGAASAAPAAATTAKPAKACSTATAAALQAAAKMPAGWKIKKSSINCWNNTLAKAEFTAPTVEQQGDGMTVFKYRTGTKKWVKITEGSSIDCADLGIKKHAAHPSWCIPA

SEQ ID NO: 15572 - protein, 178 aa, Actinoplanes utahensis
MPGMGVCPEGHTVGCPDRTGGRRTMAAELRADEIAEIGKAIARSGLYLQFVPQPTALETCWYTVGLTRYGHPELILFGLPPDISRPALQAVAEEIIAGRRVLTAGQRAGDILEGHQVELVAVTEPDRHLPVAAQFYEATGAVVEALQIVWPDRHHRWPWQPGTRVDDMPVLGRPTSAG

SEQ ID NO: 15573 - protein, 320 aa, Actinoplanes utahensis
MRSDYDVIVIGGGAAGLSGALTLARARRSVVVVDAGAPRNAAAHRVHGLLGLDGIAPAELLDRGRKEVRAYGGEVVRGEVDAVTAAAGGFDVRLTDGRRAAARRVLVATGLVDELPEVAGLRERWGRDVIHCPYCHGWEISGMPVGVLATEEVSAVEEALLFRQWSDDVVLFTHTGPTPTAQDAERLNARGVRVQAGKVSALEVADDRLAGVRMSDGTVVDRAVLVVSPRLVVAARFLRPLGLVPCEEESGTGECFRVDATGHSAVAGVWLAGNVSDTAAQVGTAAAAGATAAAHINTDLVEEDTARAVHAARREPDHLS

SEQ ID NO: 15574 - protein, 114 aa, Actinoplanes utahensis
MTDDYYTIVRGRPYRAADGVTTVRVRLDGEFDLAARPALIDELTAAAGDGTRILVDLDRVTMLDSEAIGALLAGFEAVRHDATRFRLANARGVVRRVLDISGLSFLFATDPAAG

SEQ ID NO: 15575 - protein, 505 aa, Actinoplanes utahensis
MASRLMRLHVVIAVVAVGGFLAVPDGSTLQLVWQVTAGWLAAVMMVIGIRRRRVTPAAPWWLFAIGVAGNASGILVEYILTHTQVDPGFPSWADAAYLSLYPAAAAGLLLMIRRRNVQRDWATAVDATTLTTGIGLLAWIFMIKPAAEDPTIGLLGHIVSVAYPLGDIVLLAMTVRLLLSGSGQNVSFRLVSAALICFLAGDGTWAVINQLAWEPGPVPHRLLADVFLVGFLLFGAAAVHTDARSLSRRVAPRPARISRSLLATLTATSLIAPVLLIVQTLRHQVSDALSIAVGCIALFLLVVTRMTQLLRQLDAQTEKARELAVTDELTGLPNRRAWNTELPRGIERTRRAGTPLTVAVVDVDHFKRFNDAYGHPAGDRLLKEAAAAWQEQLRTVDHLARYGRRGVRGDAARRHRRAGARHPGPDARRHSPGSDLLGRPGRVGRHRDLGRADRPRGRRALRGEARRPQPDRRRRLSAPRLSPAGRPGRPAPGGVPRWRPAGRVW

SEQ ID NO: 15576 - protein, 433 aa, Actinoplanes utahensis
MTAAVVPKVESALLRGAAAMPYGRGVRNRTAWQAMAQSPLGFLRSAWPWRALAYLVSGVLTGALTCAILAALIAAGVAGLIVLIGPVFLLAAALSGLPVARLERRRLRLVDADRTGDPHQTPAAPGPRAWLRTRLAEPATWRELAFTLLSATALCWLDLVVLAFAFAVPWICVEAAVEDPAVWPWAIAGVLLLSAWPYTVTSWAGARAALTRTILSPRDRELGEQLTEVRRSRARLLGAFEAERVRIERDLHDGAQQRLVSLSMQLGLLRLDTEPDSALHRRIGEAQEQLTTALAELRDLVRGLNPQVLTDNGLVAAIEENTSRFTIPVDVDVRLPARLPHAVELAAYYVVTEAMTNIARHSGATTARITGRHHADVLTLQITDNGAGGVDPAAGTGMTGLADRLGVLDGRMRISSPPGGPTLIHVEIPCPFG

SEQ ID NO: 15577 - protein, 132 aa, Actinoplanes utahensis
MTAMTTSLTSVRKVYGHGDRAVTALDDVSLHFPRGSFTAVMGPSGSGKSTLLHCAAGLDRPTSGQILIAGRDIGALDENDRTRLRRDRIGFVFQAFNLVTSLTAAQNVELPLRFAGRRPGPDAVHAALARVG

SEQ ID NO: 15578 - protein, 81 aa, Actinoplanes utahensis
MLFADEPTGALDTVTSGEVLALLRQLVDDERQTTIMVTHDPVAAAYADVVVFLKDGRIADRMTPRRDAPELIAARMTRLEG

SEQ ID NO: 15579 - protein, 788 aa, Actinoplanes utahensis
MLALANLREHRRSFVAALLAVALGVGLIGVTLLVYDSARPRVPSRFAAAPVLVVPHRAADESGHLRDLIPWSEADAAALAHRLRDGAVIDRSFYAQAFLDGRPVAGDAARDAGHGWASTRLAPYRLVAGAAPQTPGEVAVDASLGVRPGDRLQVDLASGPRRLTVSGTVDGPGFYFTDEAAARLAPGVRAIALLRHDPGTARSAVGAAGTVLTGDARAALEPQFVAHKRFLGTQLITAMAALGLFVTVFVVAATLALATTQRRREIGLLRAVGARPGQIRRMILGEAAGIGLAGSMAGAALAVAAAPLMKAILTGLDVTAPGFTIRVSTWPLAAATLIGVGVAVAGSWAASRQAASVTPLAALLDAPAAKRAMTPARGLAGAGALSLGALLAVLTAVSGADDRINTAIGAAMCLIVAAALLAPVLIGPVVRVVTAPLVRRRASAGPLLIRAELLDAAGRAASTAAPIIAAVGFAVLISGMVQTMRTAYPAGETRKLAGQVLIAPDGTPGLDDQVVAEHPVGKAALPTRVFLDRPGRGPTVIDALGSRDPRWDRPGEAVLGVSTARMFGVAAGRNVTVRFVDGLSETVRISQVLPDDPARGAFVLSRALVRRHDPAALTDTVFIPQADAPRTVAAGAALHDAQSYALADYDTDARLTAGLATMLIVVAVGYSGLAVANSMAMAAYGRRDDFAVMRSAGGTVRQLIGFVAGETALVAAIGITLGVLVTLPPLAGMASGLSQVTGTDVTIHLDAGTVTAAILGSLVTAVGAAVVVTWRVLRPDPGGTAGPR

SEQ ID NO: 15580 - protein, 429 aa, Actinoplanes utahensis
MRGLALGDAFGETWLMEPAATLADALLARHVKDGPWLWTDDTAMALSLLRVLDRYGRVDQDALAVAFAESYAADPYRAYGPAMHDVLLAIGRGVPWAEATRRKFDGMGSWGNGAAMRVAPLGAWFADDLDTVVAEATRSAVVTHAHPEAVAGAVAVAVAAACSVRGVPPAELIAAVTDRVPDSEVAARLRRAARIAPSADPRHVAGMLGCGREISAVDTVPFAVWCAATHLDDLTEALWATALPGGDIDTTCAIVGGILGGRTGLTGVPPAWLAACEALPPFVDEIGDAHRASIGRVHTPSRMSGLPELTGVRKVWFSGWYDGPVTGIAEHDGHEYWFVMVVNDGGGAWDFEPRVYLLHRLPEEQLAEAWQAHRSFTAAGLPGCLHSPPCPVNPAEAPTREALWERWPPEQEDHYADAPAIGWFRDAAG

SEQ ID NO: 15581 - protein, 197 aa, Actinoplanes utahensis
MARVIMQAVVSVDGFIAYPDDSVGPLFDWYGNGDVTVHANEQWAFRVSRASADHVRPFWGDVKCTVIGRHLFDTTDGWAGVPAAGDQVIVVTHRPLPAEWLARFPDAPFRTAGSVEAGIGLAKEVAGDGLVCVTAGDVGGQAFTAGLVDEVAMDVVPVVFGAGKRFFGAHTGTVLLGDPDAVVRGDRVLHLHYTVRR

SEQ ID NO: 15582 - protein, 227 aa, Actinoplanes utahensis
MDVVLYNMVTAAVLILAFKAAQRLAPRRRFPVVAVALTALIIGGLILQATWPGAMAALDSDPSRSGWWRPLTSVLMQNGGFTGDLWNVLTIAGIAAYAEWYWGRLAAAGLFLAAALIPHWLDVFVGDAQVSNEPRNWAGSSGVTYLVAATLAGALAIRALRTRRVKDGLLAVAAPLVGLATWFVQDNAHGLMIVEGFVAGAVLAALFTERRVDPEPATLATDQRRTV

SEQ ID NO: 15583 - protein, 203 aa, Actinoplanes utahensis
MKLTRERIVEAGMLTFAEHGYAGLSMRQVAERLDVHAGSLYYHVRNKEALLVLLADRLASRAFEAGEKALAELPESAGWADRVEAQAGALRQTLRAHAGGPLLLAGSPAMLSAQALALMERLLATLRDGGVPEADRTVLADVVLSYVTGFVLQEQAEPETAPPGDVDHAALTARFPLLFAAPPGSSDEMFHRGIRQICARAGS

SEQ ID NO: 15584 - protein, 73 aa, Actinoplanes utahensis
MSWSFSFVAAASILGNWLGVFLDLPARPRLALTAYAVSFLIAIVVVLRALPSESPAGHRSTVPASGHDLRRRS

SEQ ID NO: 15585 - protein, 335 aa, Actinoplanes utahensis
MTLGLATSIIGSRVVDGGSSGAVAESVLPLAWLAVLATGSAGISFAAPLIARLTAPHSPARTLVASDLAEAVVSVIALILLVVSPGGRSTLLGGYLLVVAVFPAIMDVVEELYGQQIAQLDEKEALAFNTNIYSVLGFVGLAVGMPLGSWLTGRSIVWLVAANALFSFIGFSFRLVSSRTLMVGAIYDQDVSECSAVGGRMKLREFLSDLLRTGPTSPAMEFVLKVGATMAGVFVYLWVASFTPWPAGTALAAVLLAFGVGATIGPYVAPVLRRTLAPRTALLVTYSFAAVVSSAMAVFAGVVERHRLWVIGLAFVLALGVVSRARAVLTVTLRQ

SEQ ID NO: 15586 - protein, 134 aa, Actinoplanes utahensis
MPGQLEVEELLIARDLHAVSPLRTEYLPGELAQCDLWFPPVDVPLGFGQVGRPPVLVTVIGYSRWLTAMMIPTRQAPDLLAGHWWLLTGLGAVPKALVWDNEAAVGSWRAGRPQLTATARPEPVSAGIGAQRFR

SEQ ID NO: 15587 - protein, 214 aa, Actinoplanes utahensis
MRVVLAEDLFLLRDGLSRTLREHGFEVVAAVDNAPSLRHALLTEKPDVAIVDVRLPPSFTDEGLRVALEARRELPGLPVLVLSQYVEQLYAHELLADGAGGIGYLLKDRVTNAEQFLDAVRRVAAGGTVLDQHVVVKLLARGEARGRIGSLTPRERDVLELMAEGRSNAAIAAGLHITESAVAKHTASIFARLDLVPSDDVNRRVLAVLAYLKR

SEQ ID NO: 15588 - protein, 672 aa, Actinoplanes utahensis
MAHAARKRIVVGVPVSLSSEAHRGSDRGSSSFAGMADGHRLLCRRHGSGRGLRRRATFHRHSRRGHPADPVRAGRCRRGAGRGVAGPHESTAPRRRLRRSADRSGAVEHRCTDRRRRGRGPWRDHRRRRFHPARASVPAHRGRPADRCVRRGDRLALPAATAVAYAVRPAHRVRAGRPAVGSLARPRVRRGPLVRRPLPARHDRAVRGDGPGAGTGPVVPATAGRGLPHVDQSRHAAVHERGVRRRTAHRPFRSVRRGGGARGDGISPMIRGLWRCQLMSWFTIVGWLTGSLTMLAVLALPVGVGFLAVTPAAVLLRRVSDVARGWAGVTDRPGPLPSRAVAILGTEAFWRDLTWAMVDPLTGGLLLAVPIAFFWYGIFGVLVQPFLWRSLGPGNWYAFIPVDSVATMLAALMLGAGFVAIALTSATVVLDRHARWTRRMLAEPRNAALARRIAQLADTRAEALDAQATELHRIERDLHDGAQARIVAMGMTLDQVARLLDTDLPQARRLLVEARTTSDRALTELRDLVRGINPPVLADRGLGDAVRALALDSFLDVEVAAELPGRLPAPVESAAYFAVAELLANAGKHARARTVRISITHDGDALHLTVTDDGAGGADPANGTGLRGVRRRLDRFDGTLAIASPPGGPTQVTMEIPCASSSPKTSSSSVTD

SEQ ID NO: 15589 - protein, 534 aa, Actinoplanes utahensis
MGHGGRRAQHVRQTGRRARWVHGGRRGARAHDDGHHDQGCRHGDGRPVRRDQGGLRRLLRRRGARPRPRRRDRQAVPGSRRRCRGPPGRGPDDEPVLIAADDEPTASALQADAVAAALAQAHRSEWAFVLSATVRVTGDLDVAEECAQEAYVSALRAWTRDGVPERPGAWLTTAARNQALDRLRREVTLRRKLPLLVEPATVDPHDPADPNSPDAAVPDDRLRLVFTCCHPTLAPEARVALTLRLVCGVPTPDVARAFLVSEPTMAARITRAKKKISEARIPYRVPGRAELPERLDSVLTAVHLLFSTGHTAGEGDALVRAELCDRALHLARTLAALLPEQAETRGLLGLLLLTDARRATRTDEQGRLLLLADQDRTRWDQRAILQGLTVTAGALASGPPGRFTLQAAIAGVHAVAPSLEQTDWPRVVHLYDLLLAVWNTPVVALNRAAAVAFADGPAAALPLLDELSTEPRLADYPYLPATRADLLRRLGDAAGAAQAYRRAMELTANAAERAFLEQRLAEVSRAAGAEPAPG

SEQ ID NO: 15590 - protein, 817 aa, Actinoplanes utahensis
MTGNREHRLPATREQEPRRRGEPPRYGHIPGPVTDTWEDIGDRTWGEQAGECRLSTRRLSPSLTGLVGAVMWVIAAAYTVGLVLQPPGFVVAVDVWLNIAAIAAPALVCWAAVLTAGGRRLELVFMAVGCTSYAIGNALLAMAAARHVTVVTPAWSDAGFLLFYPAVLAALVTVARRALSRRSGQVWWDAAVAALGGATGLAVLLAPVFSGISGSPLQMIVAAAYPAADMTLVAVLLGLMCLHGARFPRRWLPLIAGLALFAAADISYTLRVAAGGYTVGTPMDGLWALGLATLATWTVRCGRERSGAGIDSGEQPYSPSLLVPGLSSGVALAVLVAGSTASLSRVILLLATATVLTSAGRTHVAYRQLRRMAQLTREARSDDLTGLANRRAFYDHAGRRLAQGSPFTLLLIDLNRFKEVNDSLGHHVGDQLLQQVARRLAAQIRAGDLLARLGGDEFVVLADAGDADAALSIADRVHEALSAGFELDGITVHAHASIGLALAPHHGRDVAMLLRRADIAMYRAKSGRYGNQLWQPNNDEASADRLRLQQELREGLRTGQLVLHYQPKIDLHDGQVHSVEALVRWQHPHQGLLYPDAFLGLAEDAGLMHELTTTVLHLALRQAAHWHAAGHPLSVAVNLPPSALMDAQLAARMTDLLRQYDLAPAALQLEITEDAIMGDRERAAAVLTQLRAAGVRIAIDDFGTGFSSLAYLRDLPVDDLKLDRSFIMPATSDDRAAALVSSTVILAHSLGLRMVAEGVEDLAGAEQLQRFGCDQAQGYLYSRPVPADQLIAWITSRASAAAAAAGSEPIPAAVAVG

SEQ ID NO: 15591 - protein, 757 aa, Actinoplanes utahensis
MPAPAADEVFRGGTGLRRRLWWLTIALGIAAIGGYFLLPGGGFAQAVAYNAMGLLSGLAMLAGVWLHRPSRRALWIFFAAGQLMNVAGDVIWNIYEYGLHQEPFPSVADIFYLGSYPLLGAGLVRLVRQHHGRRPRHLLDAAIVATGTGLVFWVFVLHPAAAAAANTPLERMINTAYPAVDVMLLAILAGLFTLPGARTASTWLLAGAALALLVADVGYSVLTAHLSFDDGNPLDAAWLLSYVLWGAAALHPSMSARPAAIAHGVGTGLGRGRQALLAVCSLLAPGLLFVPGVAARPADWMVAAAGTVALFLLVSARMSGFVNRVQKQAGQLEKLALHDELTGLANRRRFQAQLSAALGNGPCCIALLDLTGFKKINDQFGHRVGDLLLAEVAGRLTAAADHPASVARMGGDEFTLLLPAASRESATEVAEHVRRLLAQPIRVAGHELLISANIGLTETDSLGDPVEALRRADVAMYAAKELGEPYRWYDLGLDRRAGEDARVGAELRTALDAGQLRLVYQPIVELPTGRQIAVEALVRWHHPDRGVISPAEFIPVAERNGTIVEMGAWILRTACLRMARWHAEHGPAAPRHVSVNVSARQLARPGLAEVVASALADSGLPASCLTVEVTETAVFETDRAIQTLHQLDAMGVRIALDDFGTGHSSLALLRTVPAHALKVDKSFVDEVTVGGRTSVIAAALIQVADALGMTAVAEGVETAEQAAELHRLGYRLAQGYHFGRPAEQPLPAELPLIAEAA

SEQ ID NO: 15592 - protein, 119 aa, Actinoplanes utahensis
MRLTGDSYCARQRRELLARRRAADPPALRVPERGETPIAANGVKIMLRRRGALAGVATVHAHRWRHNFAHEWKLAGGDTGDLMLVPGWASDDVPSRDGAYAAAERARARSFQPQTEEPH

SEQ ID NO: 15593 - protein, 937 aa, Actinoplanes utahensis
MDRRTLLTSVAAVAAVTPFVGGGAARAAAPGYVTNRAPLQPEAFIKLKPGSTKAAGWLATQLNYQLNGLNGRMTEVSHFLQYDNTGWVHPDLAGWEELPYWLKGYSSLGYVTGDANTQSVTAKWVNGILATQAGDGYFGPTAQRTSLNGGPDFWPHMPMLHALRTFAEFTGDFRIVPAFTRFFHFMNAQPVSAFNQSWGAQRWADTLEVVYWTYNQTGDSFLLDLARKIHGNSANYIDNLPTLHNVNLAQGFREPAVYSVLSGDPSHRAASYNDYNMIMNSYGQFAGGGFAGDENARPGFGDPRQGFETCGIVEFMASHEILTRITGDPIWGDRTENLAFNSLPAALDPQQTGIHYVTSANSIALLDRPGHAGQFQNGFAMQAYMLGIDNYRCCPHNYGMGWPYYVEEMWVATPDGGLAATLHGPATVTAKVGDGTTVSIKADTVYPFGETITYTVTTPKALAFPVYLRVPGWCTSPSLTVNGAAQTVAGGPAYAKIARTWANGDRIVLKLPMQAKTRTWTANHRSVSVDFGALTFSLAITESWTRVGGSAAWPTSEVRPGSAWNYGLDGATQFSVTTGLGNVNDPFTAANAPIRITTPARRITGWKADADTIVTTLQDSPTPSTEAIEQITLIPMGAARLRITSFPTIGAGTPWQSAGVAFRIQNQNSGKVLGVDSMSTTNSARVVQFGDNGTADHLWRFLDNGDGWVKIQNVNSGKLLAVDVMSTADSAQVVQFDDNGTADHLWQVLDNATGYVRIKNKNSGKVLGVSGMSTADSANVVQFSDNGTTDHNWRLIPDGTVKLQVTHTSDVLAINNMSTANGAQLQQYPAVGSADHIWRFEDAGGGHFKILSNMDGKCVDISGQSTADGAKAVQWDYLGGTNQQWRLVWTAPNVFALVARHSGKVLEVQGQSTANSADVGQWPDLGLANQRWRIIPA

SEQ ID NO: 15594 - protein, 1828 aa, Actinoplanes utahensis
MAEELLYSSDRTHVLLQSAADGTDPLICKRASGPGAVRRIEHERRVLCHLDGVAGVPKLAARQGRQVLMLQVDGVPAAPGVQLPVHRLVEVACQLADTVAAVHQAGVLHRDITPANLVIPDLGRPVLVDFDLAVLLDDGAAGVPPPEEPLGTLGFLPPEQTGRLRLPVDRRSDLYSFGATLYALATGIPPFPGDEPLESVRDILTRTPAFPGDRDPRIPRQLGAIIMRLLEKNPDRRYQSAEALGHDLRRLTADPDTGWLLGERDFPAVLSGPAQLVGRDDDMRRLDTALERVLSGGGPAVLVAGPPGVGKTSLVAGLRPRVTARGGWFAAGKYDQFRAGTGTGGIGRALAAVAGLLLAEPEPAMAADRKLLTATLGPNTATVVTAVPELAPLLGPPAETFSYDPGTASSRISAGIIGLLRVVAGRRPIVLAIDDLQWASSSQMRVLDAIISAGPIPGLLVVGTYRDQQMDAGHPLTPLMTRWAAQGLTSPTLRLGGLAPHSLADLVGAVLRMTPATALDLAELVSAGTRGNPYATVEMLNALRAEGLLTLGATGWRWDPAEVRGFIARYQVPDLLATRIGQQPEPTRRVLGALACLGGNARPTLLGAALQMPESTLARHLAAATADRMITMDPAGTVRFRHDLIMQAARDGMSAAERADLQLDMARQLAGREDCRREAAEQYLAATDRITTPRERAVAARLLHEAGRHCAGLTNFTAAEQLFGCAESLTANRQGDQCLRDVIAVDRHAALYCLGRLSDADDVYHDLVGRSPDLLTLARAAVNQINSLTQRGSITEAIELGLAVLRRLEIVPPGDLSCSIDAGLERLYRWSAQLGAGPRADAEVETTDPRIVAAGRLINRLLSPTRQSDSPMLYDWLILKAHELWEQYGVCASLVGSLSAVTCVTIGLRDDYRTGYRLTQHIVEVGQRHGYQVETAIARYILLCEAAHWFQPLEDILDVARQAGDELVAAGEVQVASMLANRLVAALLDGSETLQAAEDELTPYLTFAERTGGRLPTFILTGYQQLIRALQGRTAGPGSFADADFDEAGYRSAIGSLGTPRATYHANRALTALLFDDSAALDEHSAAAMADVLPMRGYYVSMLARLTRALSLTARIRAGQHDPALTAELDSVRNWLARRADDCPRNFRPLRHLIDAERAWAYDDAATATREFDAGLSEVSGRPWHRALLAERAGLFHLAQGLRHIGRQLLFEARDAYRAWGADGKVTAMEAAHPFLRATPAPGTGSGPGIAEFPGIDLMAVLRAAQALGSQSTVAGLQARVGEVLSAITGATDAHLVLENPETGQWYASTITGAGADAITGATQVRDPQAATPPDIHTDHRLPLSAIRYVLRTHEPLLVPDACRDDRFARDPYLAGLDICSLLVVPVPSHNVAHAVLVLENRQQPAVFSTDRLETVRLIAGHLAVSLDSAIVHDSLETTVAARTADLAATNRRLADSEQRLRSQFEHAAVGQVIHGPDDRIKEVNPAFRTMIGMPSERLTGRKLTDLVPVPARDEHRCQLSALIADRQSLISHELSLLRADGTQLPTHVTVSAVRDADGRPGHLISIFQDISARRAAEAARDEAHRQLAERHRELEAANQLKADLIGMLGHEINNPLAMILGYVDLGLSDDELTEPVTDLLERIRRSVHRLESIVHEVLALVSIDAGRLTALPQPIRVAEHIDAALSATATAGLPVTCPPDLVAAMQPGHFDHILTNLISNAAKYGGGATAIVAAPSDSGQSVTVAVHDDGPGVPPEFRTHLFERFTRAHRTAGTVSGTGLGLYIVRELARANGGDVNYRPAPGHGSIFELTLPIPATTLLDLVSTPT

SEQ ID NO: 15595 - protein, 203 aa, Actinoplanes utahensis
MTGRREHNKRQTRRSLQDAARRLFSERGFDQVCVEDIATEVLVSRRTFFNYFDSKEAALVDPDPSRLDTLAALLAARPADEPLLNSLCAVHIQFLMADPADFASRMRLVRANPALRQRWVTAIEIFDAEVVRWACTCTGLPPEAVYPQLLAALVGTVSRLAMEHWDPDTPPEQLAEVISCIYRLLAVLGNDADLPPADPGCEH

SEQ ID NO: 15596 - protein, 152 aa, Actinoplanes utahensis
MTNSRQLAVVALDGIPAACVPGRLPVVGMLEIGPAFAATARIREPVVRIQYDNRYHTAPLDGSAAGDVDRAGSAILLSDIMLRSRSDPPIADQWRARHLDLQMVYTSGYRDDEPRRRYDLRAGTGLLQKPFTAVELLAAVGRTLARAASRRS

SEQ ID NO: 15597 - protein, 769 aa, Actinoplanes utahensis
MGLAMTREIRDRAGAGLVAVAVLGVLTAAASLPWGARGWLAGSIGGAVVAVAATVSCLRLRTVPGIPSSVRRFWQLWAASAALLFAATLGAAVGIVRGDAGMQVYEAVPALLSVVVAVLAFRYTRLGRRTAVDRIRLILDGAAIAVAGALLFGHVVIGLAPPDTPLLSRWTVGAVGVGCLLALVVFGRAAASPGGRVDPGALGILAGAPLIALVTAVSYLSGSETSLMLLSMLGYPLVALAIGGAAHRQAVVLARAGAGRAGRRPRGSLLSPVPFLAVAGTVFLVVAVSSRDLDPRGRAVLTGVVLIAALVLARQLLNLRENGEALRDIRRQQAELEQMAVNDPLTGLVNRSGFNLALARRLRDRQPVTALVMDVDDFTRVNDTLGPAAGDVLLGQIAERLRKACAAGEIAARLAGDEFAVLLPSADRSAADLAAARFQELVRRPVSLGGQHLLLHASIGVAIAVPGETADEVLRNAGIAMSAAKDVGQASYVRFEPGMRHNLTNHARIAGELHDAIYRGELRLLYQPVFDLETGRLHGAEALVRWQHPARGFISPGEFVPVAERSGLIVPLGAWVLRESCEQLARWRRRYGDAAITAINVNVAVRQLRETTFVAEVAAILAATGLEPNNLVLEVTESSVADGWRVRETLQSLHDMGIRLALDDFGTGHSSLSLLRAFPVDVLKLDKSFVDGIADGADRGRLAVAAAVAQLAEHLQLKAVAEGIETQAQQDRLRDIGYRYGQGFHLARPLPADECAAIMAGETVPAARQ

SEQ ID NO: 15598 - protein, 164 aa, Actinoplanes utahensis
MNALPRPAVERVQPPKAPYRMVNRAMRWLLSSPGRARRIGQHLLLLHVTGRRTGRRFTLPVAYRDAGDGRLLVLTNSIWRVNLRDRGDVSVTLFGSLHPAKAQLVEDPDLVAAVYRELIEAVGHDRAGRRMGIRINVDRTPTLAELAEAARRDGLAVIYLDVAR

SEQ ID NO: 15599 - protein, 287 aa, Actinoplanes utahensis
MTPPILVTGATGNVGGAAARSLLAAGLPVRVAGTDLRRLQARFPDVESARLDLHQPDTFPAAVSGTSGLILVRPPAIARVTPTLNALVDTVARHAPGHVVFVSVTGADTNRVVPHHRVEKHLRATPLPYTILRPGFFAQNLADAYRADIRDHDRIYLPAAQGRVAFVDTRDIGDVAATIFADTTAHESAAYTLTGSEALTFHAVAGLLTEALGRPVSYQPASVGGYLRHLRRQRLPLPQCLVQTVLHTGLRHGQAEQVDPTLARLLQRAPRSMAQYVRDHREVWKQR

SEQ ID NO: 15600 - protein, 190 aa, Actinoplanes utahensis
MSRSTDPRVLRSRATVLTSALALLAERGIAGTTIEAIAEHSGVAKTTIYRQWDSQAALILDAFDSVLALPEDPATGDLRSDLLQLLTGFADALRTSPATGLMFALIDAAERDPAFAALHRRQAETRHRLILDVITRGIEKGELPADADPDELLDLLAGPVFHRRAVSGGRLDAAFAERVVDCVIAAYRTT

SEQ ID NO: 15601 - protein, 57 aa, Actinoplanes utahensis
MPMPKLGIPARKDQPPACGGTEGACADWLASLKRISRNATSPGPPAPPGPPAAPHEP

SEQ ID NO: 15602 - protein, 150 aa, Actinoplanes utahensis
MLHAARTLLTTEPWLMTSPLTDVMDSLSWSMSDFDPEYPDLGALIDSGWGLGPSSGFVGLDEQTLVQQILLNLTERVAGRGAEADAFLQDVFAAAAATLTGAFGRPDRTLYGEEPQLWWQRPATMFGLLTRSDSVSLQLTPSELTGGEWE

SEQ ID NO: 15603 - protein, 148 aa, Actinoplanes utahensis
MEVSWTAFRDGLAGSIATLPDGGALLVGDQERTECFVQFMFSRSLAEVASGWDPLDRPNLTEEQTAALERIGWPAPSFDPSRNHGLNLSWPAPSAEYRRVADMSVVALREVFEIPSPASLAYKAFVSPSGSNLPMPHLGIPSCSDLWD

SEQ ID NO: 15604 - protein, 141 aa, Actinoplanes utahensis
MTGLDWQTFRDGLVRSIASLPNSGALIVGDEERTECFVQFMLDYDHVVAEVASGMDPQDRPNLTEQEAAALEKLGWLPQAAGDESAIEAFKQDAFTAAAAALTGKFGRPTDPLPGEEPQLWWRRQNTAFGLITRATRWASS

SEQ ID NO: 15605 - protein, 166 aa, Actinoplanes utahensis
MTEAGMVQWREVDEATVLRVAQTLLSLEPLLLSASVQEVAAKAGWTVTRFDPERSNRSAFLDTGYGFGSRSAFFKTDASSKVTSILVSVTEEVAGGGMAADEYKLDAFAIAASALTSAFGKPDRPRPGEEPQLWWQQDTTWFGLITEHDGVSLQLTPAERMVGEWS

SEQ ID NO: 15606 - protein, 122 aa, Actinoplanes utahensis
MVRDLLPAHAGFEPDRHDRRTGVRLRRTPHPPKHLTCDVHVDPKPGELDIWGLGHDRRGLPTLVVVEAKGGIAGTGGRDRLQQGSAPYLELTMRLDPKFQTFLRENPVIAEQIRTGVIKVEC

SEQ ID NO: 15607 - protein, 153 aa, Actinoplanes utahensis
MTDLDWPAFRDALARSIATLPNGAALIVSDAERTVCYVQFLLDRNTVTAEVASGLDRWDRPFLTEEETATVEQIGWLPPDNTVVNHGVKLAWPTRSAECRRVADMSVAALRDVFEIPSPANLRYKAFKVAGGAGVPMPKLGIPARKDQPPGTQ

SEQ ID NO: 15608 - protein, 142 aa, Actinoplanes utahensis
MSAEPWLMTTSLTDMAARFGWTVSSFNPDRPTLGAFIDDSRGLGPRSGFVDLDKQSRVQHILLNLTERVAEDRWEVDAFLQDVFADAAAALTGEFGRPTRTIYGEQPHLWWQRPPTMFGLLTRTDTVSLQLSPNELMDGEWE

SEQ ID NO: 15609 - protein, 347 aa, Actinoplanes utahensis
MAATGRRRGRREAGCDPQRVVGAAGTATPEQVAGAGERGAAPGCGVLVAGESAGKRLYPLVSELAADGIPVAVTCRVLNIARQPYYRWLARPVTPTVLTQAYRANALIDAHRDDPEFGYRFLADEARAAGQPMADRTAWRICSGNGWWSAFGKKRRRGKSRKVGPPVHDDLVRRDFTADGPNRLWLADITEHRTGEGKLYLCAIKDVWSNRIVGYSIDARMKSRLAVAALDNAAARRGDLAGCVLHTDRGSQFRSRKLQRALARHQMVGSMGRVGAAGDNAAMESFFGLLQNNVLNRRTWATREQLRIAIVTWIERTYHRRRRQRSLSRLTPIEYETIMTPPASQAA

SEQ ID NO: 15610 - protein, 217 aa, Actinoplanes utahensis
MLEAKRPVEHVSILVGMRASFDDRWIWSNRYSSLGLSLTFVEGGDEGGVLRAFGADPGEAEVLSLDECGEEFGYELPVIRVGEVGGWRFAFELFGRSGSQEDVVVALSRGSRVVQVLRTGSAVSVFRYAVGGQMVCSLDPLMPQSRSGSDPDRLLDAMRTVGLDPDRPDDELDALTAMLRLVSEVFGIVLEAGIVEGPLLSAEQSVDMSWLDADNEV

SEQ ID NO: 15611 - protein, 153 aa, Actinoplanes utahensis
MTALDWETFRDDLARSIASLPNSGALIVGDEERTECFVQFMLDYDHVVAEVASGMDPWDRPNLTEQEAAALEKLGWLPPPELQEHCNHGVKIAWPAPSAEYRRIADMSVTALRVVFGIPSPDSLVYKAFVVSATGEPLQMPRLGVPYRPDWRS

SEQ ID NO: 15612 - protein, 161 aa, Actinoplanes utahensis
MVQWQEVDEATVLRLTQTLLSLEPLLLTASIQQVAAKAGWVVTRFDPEWPSGGASLDTGCGLGSSSAFFNTDADAKVTSISANVTEDVTGGGSAADEYKLDAFALAASALTSALGQPDRPQPGERPRLWWQRDTTWLGLVTKRDAVGLQLTPAERMVGKWE

SEQ ID NO: 15613 - protein, 1151 aa, Actinoplanes utahensis
MRGGIRDAGADLRLRLGENNAFGEIGTPGAEPGVGSAGDTGVQAGTRPAADHGAGGSEQTSAGTGLERSTSSPGADQQSRGESGDRAGTEPGQRSESTGGGKQAEAGGGPQRAEAGTGEQRSGSGDTARDESPQASGKPEQTSGGQSGTADRGDQRVVEPDGGGRQETGHPDRFPEAANDSDTGRGDMSAGSDRAVPERAADGSDGGADPGREVQRPGDAANGHTREVHGDSLEGTAGAGRDAPAVHGARSEGTGDGRPADAGVPAYGRHAEIGGPRIPEPAAARSAVPETAFSSGEPALPGAPEMAVPRTGELGRTDLPAHRPADISPGDTTTSPRSESPTRSSTGPERQGGEPASSSRAQDPRGDITGTNTEGGRPERPTRDDDPGRTPPRNEARDQGNRSSRRDYGHDDPRRRASEPDGRRWQDYAQRIQRWSENRAADQAAMDRALFRRFKPEQDGTARLRPETVQRVLGTPADRLDGTGQRFKQMVEQHFTDPAFKDGQPVRRPASPDDIAARLGELRTSRPPSLTGRLLHIDKLRGMLPELPRRLPQLDPIHSEHVIGGEYHGFGRPADTVSVSREMREAVPEVLDRLFKNVQFSRPEDGAPDVIRTGEGHEIKLNFGAESMDRKDVGTSTRGGDNIWQVRANSGARPEHISTVTSHELAEILQAERLQMAGETMSPKKMLIPKDTGARKLSPDDHGRIAEMLDWHERSLNGEAGARDRLGELVDHLGLRGDELGAVARRGAVTEMLDNPSAHHFNDAAAGRLSDLLQGAPEDLPAAPERRRFAEDDLRAIPDDLAQRLGIEIRPRTLQDGKILQMEAHQQTLQKIRLHVEGDPVDTFRAENGKLQNYGHDGRPGFASNDPFRKPQGWDVVNSKQRLPDHPHDAANADLIVKDSAVYRELTVELNTASADRTMKLDSVNAILDAVRSHSRVPAELLEPVTTKDVNADNLEETIQYLKEKVAPEHPELRPHIDALEQSATTWSKTYYRRTLASNRIGMIAGREFACDTFRIRPEHLTGDVQADPKAGELDIWGLGRDEHGRPTLVVVEAKGGGAGTGGRLRLQQGSGPYLELIMRLDPKFQAFLRDNPAIAGQLRTGVIKVEYYLVSQGHEEANGVVPDAKVSRFMFDGVDPGNIFDPGNIEAPRR

SEQ ID NO: 15614 - protein, 80 aa, Actinoplanes utahensis
MSSYLELPEGTEAVAQIGARLRAQAQDFKEQARQILGDIQGLDQGQPWGNDQAGKAFAEQYHKPVEGAGSLALAMQDRLL

SEQ ID NO: 15615 - protein, 381 aa, Actinoplanes utahensis
MGGAAWAAANSAERRLARAWADDDADSFADVLLHADLFLPGFPDDGASGQRLLTRERGGRTFLLVYTSVEALQEAIPAVGVGWRRTTFAELVGSWPNPAWGLAVSPHTPIGAYLDAEQVRLLGEEVAAEPPFAPGGERERAMRAAQRAGDAEVYLDLLVTADVLLPLAGPAGADDLGKPGFPWLVERVDGAATIAVFTSRQRLPDPADRPAVVEVPLLSVVRAWPGAAYRMVVNPGSPMVAEFTGAQVPDLWRWAQELVLRRTVPTHKGAVDVPVAGPRMRRVQALVDSSRALEWLAAGGGLVTGSVAPAGAAGILDGYLVRWHEDDAGGAATRQVVGLVLPYGAQLVRLVAGHELVVATYDAELSWWRPSIMSVLRGETL

SEQ ID NO: 15616 - protein, 339 aa, Actinoplanes utahensis
MTVVHPGPAGLRVRYRQGVLIDAAGFPDWVLYARAVVELPAPIAELTGDEQLVFDVLAANRVMRGADPFWPDAQSDSPGATPTPAGWCWARMPTFDDQARRVALVPVELHGAFRHGGGARTLPVGRPGFGVRTGMAPVGRVVVEPVPEPIVAEVEALLGYGLPPAYRRFLAAGNGVGPAEPAVSAVAGMVVDQPLFGLGRDDMLQDLGYAPRWLGDRFTGEVLPVGFVQGGILAIRVAGPDAGSVWFLDDDDPRDDDSLGPAEICGRLLRRCAGDFDEFWAGLRRPAAVLLEVVEDLVVGGLVREVRPELAGAALPERMRAEWQAVPQQRSISVDDLML

SEQ ID NO: 15617 - protein, 137 aa, Actinoplanes utahensis
MGATDPSAFLSLAQELRRSLGDAAETQRRVLSVTGSATSPDGLVTVVVGPRGQLVDLRIDPRVYRRPNAGALAATILATARAAVEQAVEQTRELVDARLPKADDLLGPRGQRPPGVRELMRAHDGDLKRIMDADRES

SEQ ID NO: 15618 - protein, 704 aa, Actinoplanes utahensis
MALVGRCQHRGDRADGASARGGGRLAGRGRPAGAALGGRRGCRAAGGARPGSGSPARRAGRASGRRGGEPAAPGRGAHHRGAVAAVEQPGAAQHADASGLRLPRPDAAGRHTSGTGRHSGADARSGALRLLPFRPAGLSALRDADSRSRAQRPVISPAGRCHAADQPAMCPRRACRIAPPRCDGRHPTTLVVSGRVTGRLESFGTLARWYMCGMKDRILDHACAPLLEALVDYHREDRYGFTPPGHRQGRGADPRARQILGASTYQADVLASAGLDDRSSSHQYLAEAEKLMADAVGADQSFFSTAGSSLSVKAAMLAVAGGRGQLLIGRDAHKSVVAGLIFSGVEPRWVDVRYDENLHLAHPPSPQQLEEAWNRHPTAAGALIVSPTPYGTCADIAGLAEVCHRRGKPLIVDEAWGAHLPFHDDLPTWALGAGADICVVSVHKMGAGFEQGSVLHSRGDLVDAKHLSACADLLMTTSPNAIVYAGLDGWRRQMVEHGHDLLSAAIRVAESVRDRIGRIAGLHVVREELISVEASHDLDPLQVVIDLTDLGISGYQAADWLRENCRIDMGLSDHRRILATLSMADDETTADRLIEALRRLVAAAPALPAAKPVHLPPPAAFEVDPVMLPRDAFFGPAETVPVAQATGRVCAEQITPYPPGIPALLPGERINAEILDYLRSGLAAGMVLPDSADPNLDTIRVAIT

SEQ ID NO: 15619 - protein, 931 aa, Actinoplanes utahensis
MTASRPASTGRPAPGPTTASRLRHWTIARMLTASYLCAVATMVIVGGSAFVRIGTLLGDRVPVEQAHCVLGQLAMLQKQVDDAERGQRGFVITGNEQYLDPYSAAVAAIPGTVRTLGQLTAGDAIQARLLSSVSAPLRDKLDELADTIELRRTRGFAAAQTVVETNRGADDMISIDAAIEAMREHEQQLLDHQLQVSGTAGAQTRHVILWGSLTAALLVGLGTGWATRRVNRSIAEVTAAARSVIAGKQGPQRQIKGTAELAEMAQAVTIATETVLAARDEAVQAAKSKSAFLATMSHEIRTPMNAVIGMTGLLLDTRLTTEQREYVSTVRDSGEALLVIINDILDFSKIESGQLELEDAVFELRDCIDSALALVTLPAAAKGLELVAQVDPACPRLLRGDVTRLRQILVNLLSNAVKFTAAGEVVVTVGAQDEPGPDGAVRLCLAVRDTGIGIPADRLHRLFRSFSQVDDSTTRLYGGTGLGLAISRRLAQAMGGDITVASTPGVGSTFTTTAVVRACPDPAATTVSSTVGRSVLVVDDNATNRAVLQAQLAGWGMTCAAVDGADAALAALDAGARFDVALLDMHMPDVDGLELAGLLHSHAAGRGMPLVLLSSVTWRPEPGQRDVFAAVMSKPVRPATLQTTLMQLLSPQPDGAIPPAPTPQPAVKPVSALRILLAEDNQINQKVAQTMLAKLGHRVDAVADGLEAVQAMQRADYDVVLMDMQMPVLDGLDATRRIRSEIPATRQPRIIAMTANALQEDRAACQAAGMDDFLAKPVRLADLAAALGCAEPTQGAAEQAAAGDAREREVRARLLAITGGDPGPDESRLLSRLMTSYLTKTPEGISTLRDLLAAGQPGPVRDQAHAMKGSAANLGATTLAGLLADVEHAARSGDELPEPTATADALRAEFALLQPIVRGIADELDGVPATV

SEQ ID NO: 15620 - protein, 747 aa, Actinoplanes utahensis
MTDRNDAVLKSPSRLQAVAGAHRALPMMPVPLDALARMAARLLRAPMAVLSLVGAEQEEFLGMFGLPASPAARRRTGEHLVCANVVAADGPLAVPDMTADPQFAEHPAFTGHGIRAFAGVPLRDGQDRQVGALSVLDDGPHDWSETDLSTLVEITAMLGPVPVGADPVIAMAALTDLDQSGSAADAPAAAVSATVHAEVQAGFITALLDSLQVGVFAVDTDRRPVLFNRTLRQFYGLPEDLTPAEAMAGAYTQLRHLDGTPYATDELATVRALREGSVRDVRAVMQAPDMPDRHILTNAEAIHDAAGHLLGAVATVQDVTDRRRRERFRDCELRVAGILNRCDTIAEAAPPILRAVGEALHWQYLALLLIDEVADVLRVAACWSAPGVEVGGLLPDMIGRGDAETRRLGRTDQPLPLSDLVDSHLIARHAAQTIARAAADQGLRASLAVPIRDADTILGVLVSLSSTAECDRVLLAGLLTSVTAQLGQFLIHRRNAELQAQLVHAKDDFLTLVGHEMRTPLTSIISYSTLLADELIEPELGAVVAAITRNTSTLQSIIDELLDLAGLEAGNTSLQLRPTHLTEIVNAAVTAVPVDAQRRIHTDMPPTLLVEADPHRLRQIIDHLLSNAIKYSPDGGDIRISAHEHDTGVVELAVVDPGIGIPAEDHQQLFTRFHRAGNTRHSYIPGTGLGLALVRALVHAHGGTITYDPHHRPGTRITLRLPQHHSGAGKPGNAVPGSGTLNGYRTT

SEQ ID NO: 15621 - protein, 147 aa, Actinoplanes utahensis
MTIFFYGAEEVPYGCFSNFSGHGFDLDGSWWPTSEHYFQAQKFKGSRHAELVRRARTPMRAAELGRDRAKPLRRDWERVKDDVMRRAVAAKFRVHADIRDILLATGDEEIVEDTTTDHYWGRGTTGNGRNMLGLILMRTRSRLRAEA

SEQ ID NO: 15622 - protein, 169 aa, Actinoplanes utahensis
MGMAPIDLTMDELREVARYAVRHAEVVLPIFERTVPGDHRPRAAVDAAWVFVNGERRTRLQRVAALDAHRAARQAPTEPARLAARAAGDAAAAAYLHPIAQASQVGHILQAAALAARLGEIESGADPRDLLERSRQWATPVVVDVLNRYPRIEGAGLMGDLDALLRYDA

SEQ ID NO: 15623 - protein, 163 aa, Actinoplanes utahensis
MILPKVRDPRFVTIRRGGTLTDADHHLLALWAATCAEHVLPLFEAERPDDPRPRQAIEHARAWTRGEVRMMRAREAGGHAMGAARDLRGAARFAAYAAGQAAVVAHVAAHELGAAAYAIKAARAAGDLGECRWQRARLPAAIRELVLDDQRLRNDICWSVFTE

SEQ ID NO: 15624 - protein, 594 aa, Actinoplanes utahensis
MLSMIFRPAAVLLSRLRYAQKILLVAVVLLLPLGFVTWGYVDIQRGQVRFSSTERDGVAYLRPLLDLTVHAGDATPERIAAVDAVDARYGAAFESTQLWTTAKAALGSGQATDALLALINRVSDKSNLTLDPDLDSYYVMDALVFRLPLLLSSVHQAGIASAAGDKIALAVANGALDTTKAAFANDMTTAYANTGSAGLRAARDVTDAVLADPGTDSIAAADARLIPALDQLLVARIGGFQAKAFKVEAAAALAVLLVAYLLAGFYRSATVPMRRMVTALGALADGDLTARVQVDTRDEVGHMAQAYNEALDRVRPAIEALRDEAADLSGSATELTRVSDRLRDTAAQTAAHAGRVSDAAGQVTGNVGDLATGTDEMTAAIREIAVGATEAAGVAGDAVRAAQGGNEAVARLGRSSAEIGEVLQVITAIAEQINLLALNATIEAARAGEAGRGFAVVAGEVKELSQETARATGDIAARVEAIQSDTAQAVAAISDIGEVIGRISEIQATIAAAVEEQTATTAEMGRGVGQAAAGADGIADGLTAVATSAEETTANATVTAETANRLSATAANLRDIVDRFTTSEALTAGRRDAG

SEQ ID NO: 15625 - protein, 153 aa, Actinoplanes utahensis
MSYVATRDGRRDRSAVRRAPAVPDRIDDLHGHSVGVLEVPHHMACGHASRRRYDLEDPAQLRHAYEQVLCEAAGCGEVEDLINPAMLRRVWRDLHLPSRVRDAWETRHPSLRRTINRSPSAATAEPRPAGGGFARRGRTQPVRTRTARSVPGS

SEQ ID NO: 15626 - protein, 446 aa, Actinoplanes utahensis
MTPESGDLLRIGVRVWWLRQWRDDGRLVVTRSVELDSEKEASPVLEWFMSEPANGLQVAIELLRYADVPAPDWRRLLLGLQIGALAEPVRLPLLGPEAVADLRLKVSCGALRPELLLTVDLSPKAGQNNSGRVHFMTATLGQVAQDPLARACRELAGGQLQVPRSPGGPRVRRSTWMDEVRWGQDGPTPPASALSGPTGVTLHGARGVQVGDHNLQVNNFRTEVKILVSMFHIDRGVGPGDLNGIFGVEAVQDGIGQLQQSPNDEVARAKVASLLADAAQAPVRVSPVFLPAPVEDVALHRLLAALLAFSAGAPGAGDDEDTYLAPATREVSALLTDFPRVTRTLADLIVGGDRDLAVLRRGTRAVRDLMPQEALPEPAILYGPGGGELLRVERINQMVADADGGISSVRDARVTALDFPTLRKDRVERTAQAEGEIVPLRRASRQ

SEQ ID NO: 15627 - protein, 282 aa, Actinoplanes utahensis
MAEVRVGQTLRRWSWPLPSLVVLLVVTPLTACSLSTPLCTAAAGLVTDGRLTAAEYVYGEARKSDEGDCAGDGIERVAGRRKQAAGSDATGRAAVRRHDRTRAAAAFRAALKIDRNDADAVAGLLKLGTAPSAPVAGPVTIVTTPVTGGPSIGALRSGCALALITSLALAIGMWWTRRRAGNLRAESTRIRKAGETSPRTTSSSLISIERQVRARLAQVSAAAESADLRVADLEADMAKLRERVDRAEQGHRDALLLAHQLFEALRASRPAEVVVIEESYDA

SEQ ID NO: 15628 - protein, 188 aa, Actinoplanes utahensis
MTTGAASAPPGPPPRCDRNLVPVCPSAPVTQRPSWGPARRRRKYSRRMRYEETSLIDAPVEVVWRLTVEIDGWPEFLPTVQRVERLDAGEVRVGTRARVKQPGQLSAIWTVTRLEAGREFTWETRRTGLRLTGRHLLEPAGAGTRMTLVLEVDGAAARAATAVLGGMMRTTLRRESAGFARRATAPRD

SEQ ID NO: 15629 - protein, 239 aa, Actinoplanes utahensis
MLDTECETERETELRTLMVTASHDLRSPLTSVAAHVDTIRTDYASALGEDFARDLAAIERGLHRMTRLTQDLLDYARAEYALDATPVPLGAVLADVVADHPTAAVTVATTLPEVLADAGLLRHVFDNLVGNAVKYARAGQSPRIVVSATPMADGTVLIEVADHGIGIPAAERSCVFDAFHRCANRGDRPGTGLGLAICKRIVERHGGRIGVTTGPGGGSRFWFTLPAAAAERPDRLPQA

SEQ ID NO: 15630 - protein, 470 aa, Actinoplanes utahensis
MSLYVTTAIPYVNAAPHLGHALELVQADVLARHRRLRGAPVRFLTGTDENALKNVSAAAAAGVPVTDFVAGNAARFANLAEVLDLSVDDFIRTGSDPRHAPGVERLWRQSAARGDFYQRAYEGLYCPGCEQFLSQDSCPEHRAAPEVVRETNWFFRLSRYAGAVLDALESGRVRIEPATRRAEVLSFVRAGLADISVSRPAARAAGWGIPVPGDPTQVVYVWWDALAGYLTALDGSAYREWWVASSERVHVIGKGIVRFLAVYWLALLLSAGRPLPTAIFVHDYLTVDGAKISKSTGTAVSPDDLVARYGVDAVRWWLLRDVARVGDTDFTEPRLVTRYHQDLANGLGNLVNRTLTLVHRLRAGIVACGTQPPRDLPDAVDRALAAFDFRAATDAIAAGVADANRLIEAERPWELDGDRLDEVLAALVATCRTLARELSPFVPGGAARLSAQLGAGPRVGAPRPAFLRLG

SEQ ID NO: 15631 - protein, 63 aa, Actinoplanes utahensis
MAATGDDTSPTEPRATADVPGRRLIDLIDAGDADLAASISELVALLDRPTGVRQGWQSAITEE

SEQ ID NO: 15632 - protein, 363 aa, Actinoplanes utahensis
MPVSLRAVVVAVEEYDAGDPWALDGPAMDAVRVVTWLRRSGVPDEGITLLVSALPHNRAAVEALGLPVRRPTRAVLYDLFTREIAGDGAAELFVHWGGHGALDDVHHHRLFCADATTADKRNVDFDALRRFLAGVDVRGLRRQVFLVDACQVLASERGYVNRLPVDGWPESPRRSDREQFSLFAAGVGEVADSLTVPRAGLFTAEVLADLTGAGLPATGLDVAALAERIDRRFTELRLAGRARQTPVYVWLKTPVREGNVYATPRTDRRMPIAALRDIVAVMLAAEEVASTPRRERMIMTMPDEIRSAVAYSSTPREHVIDWVRTCERFRTGRAALEGVLDLSMSDRAAFQRIVDAFDRHWSP

SEQ ID NO: 15633 - protein, 1097 aa, Actinoplanes utahensis
MGQSLHPEHNGALDNRTGVRQPTVADRRRLKKALLKIDRITDPGVRASILRELRTDLVDVDPARSSTAGMDIWEIFSECARRGAAETFADAVALVVDDSPEWDTFVGVMREIYAPPSLSETERQAIARVMVELPHDVLAAAVRRAELTDLVDLGGPGEVEAAEVLAVLHAYEQGSGALMERTWRLLETVAHASDPDRDRDLHRLITHAATRLGMTERLLAICTSVSSVSPAEAGDPPDLSGETDDNLPLLYQDDTGAEDMLSQITAPPVAVPAVMRGLPPRNAYFSGRTDLLHRIRDTLQSTSEAAVLPHALQGLGGVGKTQVALEYAYRFSSLYKLVFWIPADDEQAIRRSMVSLGKALDMPETADVQYMIDNTLDAIRVGAQYSSWLLVFDNATDVKTVRKYIPSGDKGHVLITSRNAEWRGVSNFIEVDVFTPEESLAFLRQRWEHLDPEQARLLTERLGHLPLALNQAAAFHAETGIHLAEYLANYDDLVETVTGTVPADYPRPVAATWQMNFDQLRKENPAAAQLLQLCCFLSSEPISIPMLRSGRGAALRPELKKALQNELSFRRAVQALGKYALAQIDPSRDFMTVHSLVRAVLRDSLGDDDRAAVQKAAHEVLAFANPGDPDNGETWSRHRQITPHVVPSGLVFSDDPHVRQVLVDQIRFYFSTGDYAQSRRIAEHALENWRSRLGPDDVMTLRVRFHLGNALRLLGDYRHAREETLEAHSILERTLGAGHEYTLAVANSLGVDLRFLGEYQNALASDLKTLADHRAAPDVDEFSALRAANNVAINYRLLGRFTEALEIDEANVRQRRQVDVTSSDPETLDSINELTRDLIALGRYTEAKERLTERLPQFENNLGVNHRVVLNARRHLAILHRKTGHLAEAYAHAVVAEEALRGLLGPRHDATLAAAVTLVNTMRVQGDVMAARRRGEETLTAYQETFVPHNPQTLLCAVDLAIVYRALGMRAEAYESDAANLVRLRDRLGENHPHTLICAANHTNNLAAAGEKLAALELSRETYDRSLAVRAADHPNTLAVAANLAVDLDSDGRHDEAAALRGATIERMREVLGPEHPETINVERGRRTETDIEVFTL

SEQ ID NO: 15634 - protein, 1038 aa, Actinoplanes utahensis
MLDEQKRWPVRHEADGVDADLQAVAVLAAQLCQMPMAAVSLMGERDQRFVGSVGFDGVSVDRGSSFCAEVVQRSAALLVPDTHADVRFADHPWVTGKPHIRAYAGVPILSADHVPVGTVCVLDTQPRTPSASQMAALESLAMVTRRLLQAQRAGIELVAVQQAQQAANSQFQTAFDHLTTGMTLVDDGGRFLRVNRAFADLLGYSVDDLVGRSFREFTDDTDIDTDVQAITELVAGLRRAALREKRYRHRDGSLISALVSSSLIQPDRDGPWQLLNSVESLTERRAAEARLLELHSAVDGIITIDGHGRVLAWNLGAQNLLGHSAADMLGQPLDRIIPAHARAAHNAGVARAASGQPTRLVGTTVEVPVVHAAGHELLTELSLSSWTQDGRPRFTAVLRDITAQRRTEVATALTRHAAVTANSTDVFADAAAAIVREVCTRLGWRAGHAWTADDSRAIWHVGEHLGAGGEPHPATSAPQPGPAGRCPLHVLAAQHAAPTREDLPFSSTVQVATAPRELQPMGPAVHACGIGAAVAVPVLAGGEVTGTLAFYLPHSSPAPDTEIITALEQVGMAVGRVVERQRTRAHLAWQASHDPLTDLASRRLLLERIGAAQRETATTAGTRYAVLLLNLDRFRTINDSLGYAVGDELLRQVADRLRTAVRTGDLVARLSADEFVILTRHLTDDPGGPADMFAAVAQRLLTRLAEPVQIAGHRLQLRASIGLCPISTAHAGGSHNPARLLRDADAALRHAKRRGKNQIQVFDAGMADRAEQRLGDETALAEAILGDQLRLHYQPIVDLPTGCVVGAEALVRWQRPGHGMVPPDRFIALAEDTGLIIGLGRWVLRRACHDAAAWPELVPAMANASISVNVSARQLVHPEFLADLDAALADSGLDARRLTLEITETALIGETEAVLEVLHAVRRRDVQLALDDFGTGYSSLSYVQQLPATILKIDKSFVDPINGPGDGIALSEVVIKLAAATGLRTVAEGVETREQAEALRLLGCQRGQGYTWSRPVPQDQLGQAVAGMTPAPVEGARI

SEQ ID NO: 15635 - protein, 279 aa, Actinoplanes utahensis
MRLAGIIDTPEKAGVHDHVGWVFDKPADFQVRAGRFLSAGLARRQRVVYVAGTDGDGPAEMPGWDEALASGQAELTSVRTVYSAGEPVDPERQVAAFVGAAERALQDGWSGLRVAADVTSLVLTEQQRAAWTRYELLIDAHMAHHPMTGMCGFHRTALEPSGLAAATCIHPALSEDTSAFRLYAGGHPDAHIVVAGEIDPENRLLFATTLRHARPEPLDGRLLVDASPLTFVDYRGLVELANYVADRGATAVLYADEASIAAMITRVVPLKGLQVLVRP

SEQ ID NO: 15636 - protein, 318 aa, Actinoplanes utahensis
MRTGAAAGHRGYFHETAFYDSDEAFLSTIVPFFTAGLEAGEPVVAAFAATNQNLIHDVFGDDSGIRYLGGEAQYLRPASAIRTYRELFGRYAAAGVQQIRVAGDVPHPGVGVPWDSWRRYEAAVNHAYDEFPVWGVCPYDTRTAPDHVIAEVRRTHPHIAHAGGHAANPAFEDPVGLLLAHRSDHWCDPLEQQPPHLELLDPGSGPARGSVAALAGDLLTAEDHAGLLVAVSEAVTNAEKHGRAPVVLRAWAGPRRVVVTVTDSGDGPTDPFAGLLAKRDAPSGGLGLWISHQVCGYVGLQSAPGAFTIRLLAGDLPA

SEQ ID NO: 15637 - protein, 346 aa, Actinoplanes utahensis
MSWSWWPAGVTAVLAVMPSAGPEATTGKEADGEVRVVAEAAPGLRPATVTVVATGAFVSTSAVVTVYGVVLRQVIDAFGARLVAGQVAAPDRGSVTDRSLIVWLPLLVSTVRNVTVSPVSAAVTWPAGLITAVTAAVSAVVAGATLMVAMAGPKEYGAGNPTCRPWMWASETIGSPASRSDWVTGRVAVEQTTVAVTASGAPGQVTVPNRVSVTARVSIVTLPVLVTVYAYVMLSPAAAALWWAALETVAVLAMVSVGAAAATGAVTAGAAKVRSVGVPPRRAMAPPVSEIGAPVSTSVWVMVYVPPVHVVPAPTESVVTRQDAAPPVEPLTRSVSIVTLPMLRTA

SEQ ID NO: 15638 - protein, 115 aa, Actinoplanes utahensis
MVSFFAAALCRAGGVTAAVTTADSAGAAGTTATLVENGPKVRSLAALASRPVRVAASATGPPASMSAWVTVYGVPPVQVIEAFTARVALGQVTAPPRVSVAATRVSAALPSLVSR

SEQ ID NO: 15639 - protein, 103 aa, Actinoplanes utahensis
MSACWAPAPVTVTMLLLMSGSGVLELSETALFTVVPLSVIVMVTVTLAPDARLASVHSMVPVDVDAQEPPGTTAEALVEPLGIGSDSTMLRAVDGPWLVITAE

SEQ ID NO: 15640 - protein, 286 aa, Actinoplanes utahensis
MNPYDEIRTAYITLGWLFEPGNPPLTRRVIADGPDEVVAALLDEPLIPAMLRRELRGQPDHQLWAQARHTAQDSHIITPSDSTWPCGFDPDGPLCLWSHGTGEPPYAAEAITIVGSRACTAYGSHVATDLAGGLAERDWTIVTDGGYGIATSAMLGALRTSRPPIAVLPGGLDHLHPTGNRQLLELVGDTGLLLSPYPPGAEPVRDRVLYVKRLLADLSTATVLVEAPPRSAALHAVRRALHLGRHGLIVPGPVTSVHSGGGLDVLRTDSRARPVGSVADILTDLT

SEQ ID NO: 15641 - protein, 170 aa, Actinoplanes utahensis
MGYLHYWSLLLNDPAYQAAWPQLVNDTVRIVDAVRRAGIDLAGPLGDNRPILDATGDLTFNGDRVAGHAADTFTLRRPQNGGDRPQWIAGYCDTKRFPYDLAVAATLLRCHLLVPTALTLSSDGSWERQWKYGKKLPGRRRRAPAARTLLTDLFGPIPDTDPLTPLSARH

SEQ ID NO: 15642 - protein, 316 aa, Actinoplanes utahensis
MQRPEIRITSSADAATIVAYLLGYQPVNCLTVLAVADGTVAFAGAQALDGMPDPRAAAGRLATVVYNNGFTQVVLVGYGTHQSMRDPLQQAIDLFTSIGVTVLDAMRVDDGRLWHVGCGDPDCERNGVAFDPQTTIIAAEATFAGVELAPDRETLEARLDPITGEPRQRMRAAVARILQSTVLPIDHRRAMRLIDQLTQQALAGPLSDDDAAQLLVLLAFAELRNYAVHLVHGSDEDVHAWRDLTRRAGTGTLACTPATFLALAALQGGDGTTAAIAAGRARAADPDDDFAHLLERALQAGISPQALREVLHKPQH

SEQ ID NO: 15643 - protein, 228 aa, Actinoplanes utahensis
MPEPAGPPGRPGRRGHGAPGARMNAVRTVCLVVLADLLLILSGPLLPVIMPLHAAVLGVLLIRLCSEVAQALRDPVTGISVRRVAERHLDRARGEVTVALIDGDDLHGVNRRFGHAGGDALLAALAVRLQQAAERGDVVARLGGDEFVLISRRPVDTVRRQLTAVLATPVVLSGHPVPVRFSAGICRVPGGDHRRALTHADRLMYAAKHQGGGIVTDRCPDNTDHHQY

SEQ ID NO: 15644 - protein, 223 aa, Actinoplanes utahensis
MPWTTLVCLPADTPPSDYAVQAELRLARAGLTAAGLLRHFPAVTRWRRGSLLLPLRGAAAGGPVARLQLDAMREGVHRLHWFRWQAWRQTVAGTPTAKPYWMFLDRHRAAPHRYEFARARTDYLSQPRIAAMRVYNAMPYRPFDLPTSHLEALQLGAETYTHLGWLSAVPGRALLDPDGLLLAQPDDRLDARLTYLEQANRCLNLLGRRDVLVAAVTEPRERG

SEQ ID NO: 15645 - protein, 53 aa, Actinoplanes utahensis
MRTTARSGTAGWGAVRGADVRCEPTDLLSRWWAVATAVVGGEAREVVLKGSQK

SEQ ID NO: 15646 - protein, 564 aa, Actinoplanes utahensis
MVGAAALGAAAVIRAVRGLGVLLVALAVVAGPPALVALWFVDHPQQLPSLADLTTDGPPGTRFVLAVGAIPALLVWLLVSTAVLRRGIRRARMHLRMPTPSQLTAGSMAGAVVLGGPAIVAVTAPATPAAAATTVGDTTVARGVELPDGAGWVPIAVGQAVASTAAALWLRRRRDYRPGASGSEELRPLPATVNALAALSGESTAAAALVDRLPAGGIALTGPGARDALRGLLISLLLSGRKVSITWADLGELLDDPYRAGPVPAGLRVVDDPDTTDSDEVTLTLHPLTSTGTWVSAGRGAAATRWEVDLDGTVTGTRRLCVLNARAATDLLDLLAAAHPQQPPTAGAPQQAVAALRLLGGCALSVGGRPVPVRRTAGLQVLAYLGLHPDGATGHELIAAIWPGLRPASITNRLYITISELRKDLRHGTEVELIRHERSRYRLTAAVEVDLHVVRDAAGRVDRAVTAAERRQAQRALIDAYAGELAAGCDWPWLVPARETLRRRILTGYVDLAEAAAPAEALQLLRAAITVDPCNDDIRARAAQLADEPDTALRRKPRPHQRPA

SEQ ID NO: 15647 - protein, 606 aa, Actinoplanes utahensis
MQFGAPRLAIDYGTACTRAVIAGPDQPWQPVTIDGGPEPSSVAHVDASGQISTGNTAWRLAVTDPDGFVGAPLAEGTGTVQRHGHDIEVADLVAATLRLVADEAARLCGTVPVDVRMCVPAGWGPRRRTWLRQAARRAGLGMPTLVETPIAVANHQLLAGVQLPVGTFVLVCDVGATMEASVLRRGPGGFEVLSTLYDADAGGQAVDKVLADTLLVPATGATNGTPSWAVLASMRTGKEAVSFQPAVTVPLPPPDPAVIVNAATVEAAAQPVLSRAADLAAAAVGAAEISPADLAAVYAVGAVAAMPALRPAVEQRLGVPVQVVPMPGATAVLGAAEATGAAFEETAGEVPPPTLRSTLGLLVPGILSLILFAHFVFSADFSGSRVLRTPPWWVWANWGELAIACVLTLVVCVAASPWIGLALSRDQRLKGRWDAPGQRAAGQITAVAIAAAVAALYAVAGGLYFILPFTLPLRWALLPILPIGLIVVAIALRNRKRPGPPAGDFPMLPVLLMGGGDLLFSYTVTSRHLPWLHLWFLIGTRVGVALIGVGIAMLLLQIAVLRTIAAVTLGVFGFFIADFRLNNVLGVAVSLAVTGWWAQRLWALLR

SEQ ID NO: 15648 - protein, 784 aa, Actinoplanes utahensis
MRIGLILSVVLAGFPVGLVALAGSPLPSRLPTGVDLQAWAANPFAAPFLPGLLAAIAWFSWAFAAVLSLKIAARSAHRLSRLAQYLPGPLQGLAATLLGAAAVTATYAPAAAAPPATATATGPTLLTGTITDRAPTAGHADPTCTVHRGDTLSKIAKQRLGDPDRWPTIFKLNRGKRFPTVGGRLTNPDVIFPGWKLKMPANATPPASDTCTGPAAAPTHRPSPKPSRPADSGNTVTTPVPATAAPQAAPQTNNQTGPAVTLGIAGLTIAAGCAYAAGLLWRRKRRAAHPGDPTRPASVTLLPTTTPAGRPPTAAASGAATPAASHQPITVRPPDNPATALIGPGAHDAARAALVAVITGSIADTTALTTAATRDALLPDTPLRGGVTVVEDFAAALAALDEEIIRRSRLADDLDDGAPPKPTMLVLTDVPDNAWHGRLATAAREGERLGIDITLLGEWPSGTTLTVTADGATEAGELAVLNAGAAATLLTAAEKTTPKPATVVPMTVEPATVEPVAAPAEHPTTGRVAIRILGRPAILGPDGNPVRGLRSKSLELCVYLVLNRDGAAIDDIMEGIWPDVTVARATDRLSTCVANLRNIIRSGVRGGLPPHDGNRLEPVINTGGRYHLNPDLVDVDWWQILDAHTAAATATDDSTRLDHLREAVTVAGGRAPAADTAYEWIDTDREQARRLLIRLHLQTARLVADDNPQAARTLYETACDYDPMSEELARHAMQAAARLHDADGIRHRREQLHQALAEAGIDADTATDRHAAELLNGLTFSHQR

SEQ ID NO: 15649 - protein, 272 aa, Actinoplanes utahensis
MDRLQPRHQIAIDAAVGGALAAIGAAAGGPLGAGLAQAATPAVSAVMSQIITTLADSSASRTNRTMTSAARTAGVDEHTLAEQMLLYRSKAVLLGRALDGAARSIAEEKIEWFANCIANGYLAADDAAVDRESFYVSAFAELEAPHIRVLLFIAEWERVGDHAAPPTTDELSDAFSRQLCPVIRPVLTTLERAGLVVKRRAHSSDEKMASQRETGVPHIWEITTFATHLLRRIGHTPPDRVRPSQDDLLEAANAGQPVPTTSATDVSGATNL

SEQ ID NO: 15650 - protein, 339 aa, Actinoplanes utahensis
MTEPDECYEDAIVPFWIESNQPEPPVVFARLYLDRVAGRDRVEPAWRRWRAIADQSLTPLLGPVPPEPYVDADPTPVMPVGRLERIEPTGVGVLSALRVTVEWFDGDGQAVLHVSATLGADTSRLNEVVEAAYDVLRDVAVSAEPAYGEVTVGRTGHLHRTALDIALSRSVQESARAARSVLRGYEWATVCPAELAPHVAVAAFDRVVPLARGGVLLRATSSYDEWSAGAVQRVFEALAPILPAGMPQRSHYGDLRRVVFADAADVRGGKSIIAPASAPPADLTEFIHEAVLQGWITTEPVDESAPSAVRELLPPELGVGLTEEGQRRLIELFGLDLRG

SEQ ID NO: 15651 - protein, 41 aa, Actinoplanes utahensis
MHLARPEFQRSLLTFVKSVADQANPAFGQCDYDDLLGGNCA

SEQ ID NO: 15652 - protein, 157 aa, Actinoplanes utahensis
MRASRLARILAAALTVAALTVGCDSSVPSQSNVTQHEAEQRVADRAQEALQQLPSGASLKVTLNEPKLRCEDNGDRTFVENQYAIEYPKGWPVQQAVPTLAGYWTGKGYKILRDERDDPKLARFGVEYPDEFRISIEVIHRDNGRVDAYLISSSPCI

SEQ ID NO: 15653 - protein, 75 aa, Actinoplanes utahensis
MWAATAGNDVICLTGIEDNMRFGENPANPGFGGRVFTSSDGSLNPVAAHSQYGDNLNPARSSITFIVTGQPDRVH

SEQ ID NO: 15654 - protein, 327 aa, Actinoplanes utahensis
MKVIIPGGTGQVGGVLRRALAARGDQVTVLSRRPQTLEKGVRHVVWDGRTLGEWAREVEGADAVVNLAGRTVSCRYNDANLRQMMNSRIESTRVVGEAIARAAQAPRVWLQASTATIYADARSRPDDLPHDEANGIIGGEEPDVPLYWEYSVRIARRWEREQAAADTVSTRRVALRTAMVMTPDRGGIFDYLSRLTRLGLGGPVDGGGQYVSWIHGDDFIRAVLFLIDHQELDGPVNLASPHPVTQRDLMRSLRRAWGRRFGLPATRQMAEIGAFALRTDTELLLKSRRVVPGRLLDNGFTFTHPTWDSAAVDLVSQAKELRNATLP

SEQ ID NO: 15655 - protein, 94 aa, Actinoplanes utahensis
MRAGQPREIVTKDSQVKDFSVVKRRWAVERSLGWLRRHCGLARVYETLPGSSEPLITFAMIDNLACRLTDEHTSIWRPPIAEHAKCVNQTFPRC

SEQ ID NO: 15656 - protein, 309 aa, Actinoplanes utahensis
MNAAMPPRQFPEGETPERGSSLLSISHRLRVRDYTIANLLDEHSTLTTDQLATILFDHPTTCRHRLHALRRLRFVDRFIRNRPGAPNPACWVPGPLSARYVALARGDNPPTARALRDRQDRAYASPYLDHLLEANQFFVDLLAEARRRPGEADLVRWWSERTTAAAFGRRVHPDGHGVWRDPAGETGFFLELDRGTESLTRLVDKLGAYRRLQADGGPGYPVLFALPSRAREEHLHAKLMVTGVTVATCVLGAGQNPAEPVWWLAGSVGRRVALTEIPGGHGPLGPLSPGPAAPDHHPLALLTGVPLLP

SEQ ID NO: 15657 - protein, 760 aa, Actinoplanes utahensis
MHRRPRPRRRPTVIAIVVGLSALLTVVSGAVLLVWGEHRGRRTATGGRQVLISPPPQVDAAGAVVFWATLAAVLQTGWRQRLRLGRLWTAYEYRWDGRRLRIAVWLPRAVAVEPVLAAVRGAWPGAACRVGDAEPPLPPQPAAAAGASLAPVLPGWYPLRTDHRDDPLRTLISAAAGLRTGEQACVQVLARPAAGRSRRRLIAGVRALRGAPAARSLLDPAGWALAALDLVAGGQPRPVGRPAVSADPQRERDARAALDQLAGPHWEVAVRYAVTSTRDDPARMRVLARAVATAFGPFTGRNRMRARRLRQAVTLVTGRRLRHGFVLTPVELAMLAGLPRDIAVPGLDRARAKAMPAPVGIATGGRATKSLGRAEVGGHAVALRAADARHHLHVLGSTGSGKSTLLLNLILDDIHAGRGTVVIDPKGDLVTDLLDRIPLTCARRLVLLDPDQPGGPTLNPLEGDDHDLVVDNVVSIFGRIFAKHWGPRIDDTLRVACLTLLRKPGATLTQVPELLNEREFRRKFTQDLNDPAGLGGYWSWYETSPAQLRSTVIAPVLARLRSLLLRDFVRTTFGSPRSSFDMRRILDGGILLARLPKGQIGEETARVMGSFVLASAWQAATARAKIPQEKRRDAAVYIDEAHNFLNLPGSIGDMLAEARGYGLGLTLAHQNLAQMPRETQLAISANARNKVFFSCAPEDAAQLAKHTLPELDEHDLAHLDAYTAACRLVVDGRETPAFTLRSPAPRPPLGTAQKLREALA

SEQ ID NO: 15658 - protein, 653 aa, Actinoplanes utahensis
MAHGHGRAPGRPTGAGAAARRTHRQCAGHPRGEHRGPRRWRRAGGADLRGGPVHAGRHRLVAGPAAAADHPRRCGMNRDMQVPGPAVTHAHPDHVQVADGYTATLIVTGYPAEVGPAWLDPLLSWPGRLDVVLYVDPLSAPAAASRLRRQRARLESSRLHDAGRGRVSDPLTDAAADDAADLAERVARGESKLFRVGLYLCVTAPSPQELREAVAHVRATAASVLLDTQPATWRQLEGWQSGLPLATDTLHARRIMDTGALAAAFPLAGADLPAPLPGRPGPAGGILYGLNRASHGVVWWDRWSEQNANGVVLARSGSGKSYFVKLEVLRSLADGVHVAVIDPENEYLRLTEAVGGAPIVLGTGGVRLNPLDIPADDRRDQARTRRALFLHTLIAVLLGEQPPPAERAALDRAVVDAYDKAGITSDPTTWRRPAPLLRDVAGALLNQNTTAGENLAARLMPWTHGSFRDLFDGPTTTVPTGQLVCWSTRALADELRPAGMLLALDAIWRDVDNPVTDPTRAPRRLVVVDEAWTLMREGEGARFLARLAKQARKRRAGLLVCSQDVLDVLGSDLGQIVIANAATQVLLRQAPQAIDLVTDAFALSAGEARTLLTARRGEALLLSGTHRVGFHVVASPAEHRLCTGDLDLEEGQP

SEQ ID NO: 15659 - protein, 320 aa, Actinoplanes utahensis
MSVGWALSGVLGPLLGALSALVLAGLALTWRLLSTTVLVVPDVTALPQVDTLMTTSLGVVDTCYVLAFVWVGVLVMNREWLQQQSGLGEMIPRLVVGLVAANSARPICTAVVDTANALTTALAGGRGASPVPQLQAAVFEATNGMTGSSPEDFLILIIGAGVAVLALMLVVQWVSRAGLLILLAGTAPIALAMHATVQTEPVAKLWWRAMLAAPATVVLQAVALHTTLQVMLAPQTVIPALGLTGKPGAAMNLLVVVCLLWGTLRIPGLIGKFVLRSAPSRIPGVLRFAVLQQITGLARVRMGKTRTMPPFGGGHGRGRR

SEQ ID NO: 15660 - protein, 82 aa, Actinoplanes utahensis
MVLAVYELPQIIANIRIWVIGIAAAVATLFLTLAGIRYMLANGDTGEVERAKTAFRCALIGYAVAVLAPVFLTVLKGLIGAS

SEQ ID NO: 15661 - protein, 258 aa, Actinoplanes utahensis
MGGRSWSGSPLAVAQRAFVLLVAPPTPLVLDSGTVAGVVPLDRLRGLLLSSRTGPLQRDAVWRELVLRARADGPGWVVGAVGVAMPGLRRAAGALCAGRSGDSEDLDAELLAGFVAALRRVDVEAPRICGRLIDAGVRAARRARHVPGERSFGMAGVPGPAVPARPADHPDFVLARAVAAGVVDADEAHLIAATRLEGETLSVAGERLGLPARLASAWRAQAEQRLREAIRDGELAHIALRPRRSGDGRPTLTTKAAA

SEQ ID NO: 15662 - protein, 142 aa, Actinoplanes utahensis
MQRAVVHQASARELSDSLRLVGAREIAIRLGLSRQRIQQLADRDDFPAPFQELKMGRVWWAHQVEEWIREWHAGKLPEPPMKEETVEDFARLLAERTADQLAERAEVFLDDDLIAVLAQWMRVFLDANGITPTHRLLNQHHR

SEQ ID NO: 15663 - protein, 228 aa, Actinoplanes utahensis
MSASRASLARFWRGREASNDREDHVLRGCGAEAAASGAGDSGRACDLECDGPLRGLRLPRPVSAARERGGDLLAHPATTGPPARCDSPRTGRRRTGRRAAPPPLPERRAEPVKRCPAVSTDGVHLAGQSVRPHERTLMITQSGLIAALTAIGLDTEVQIKLDGIPLDICGLSLDERRGIIFLRPHPEEIPVALRRFVAAVLGASGPGRQEVAVRHNAHGHYELIRHEG

SEQ ID NO: 15664 - protein, 131 aa, Actinoplanes utahensis
MTIAREAGERGWSESWANKMGSRQALYANLEAGAATIREYQMTFLPSLLQTPAFSEQRAQLDTADWSSRFSPARAVEARERRQRMLRRLDGPRYEVVIDQLAIRRPAATTDVLQAKSCTSRTWRPGTRRSP

SEQ ID NO: 15665 - protein, 447 aa, Actinoplanes utahensis
MPSADPEPNLLLIQARERRESPTQPGEPMSRAELATEVSRILFPDPRQRIASPFNANYVGKLESGTIGRPNRPDYRAALRRVLRASSDEELGFANRKTWIPARQASVEDPVPASAIAAESSMFGAFESIENPSGIIIGKSGDWNSFSLVTSMLAQQRQSVEPIALLRLVEAHRECLSTLFRNAGTDPVRKTIGHMLGEASIVASRLWSAHGNRNMALAHCAYAKQLAERIDDVALGATARIFGSNLHSEASTLIGPDGDVMVGLRLLEEAATVSERLTPAARARIAAEQAQTYASLRLHRPAEEALDRAHEAAGDITSEDRVGLYSDWNRSRVEVYDGTCRLLLGDPEKAVAILEPAIHELATDSQNTNVVMAAQVDLASSYAELGEPEMSCKLLGETYGRLREVGNLRGIMRARRSRDRLAHWEGKQVVQELDVRMKSCLAGRAAG

SEQ ID NO: 15666 - protein, 241 aa, Actinoplanes utahensis
MAPKEPGLVVWDIDGTLIPADLRWLRRAIARAYGLAEAEVRFPAKKVHGYTDESIAIDTAIASGVTPALAEAGIADFSTSLMSVMNEGRDELRSDQPPYPGAVGSIGELNRAGFTQTVLTGNIRPATEVKLGELGLDAYLDLDIGAFGSDSRDRFNLPAVVARRFANAFGRQLVPARTVIIGDAPNDIACARHAGFKVIVVAHRSTREELAEYGPDAIVEDLEPSTIVATVESVLSGGSAS

SEQ ID NO: 15667 - protein, 334 aa, Actinoplanes utahensis
MHRRNFLAGAAAVGAAALPVLPPSASAAAGDTIQDMLFGRLAAEPLPAQQLAAQIAAARADFRAARYTRLARRLPRLLAQAAASRSAAGTGAEAAAAQRLAEAYGIATQLLIKLHDDSMACATADRAVQAAAGNCPLIMADSQRLAATVLRRAGHRDSAQQLVLSAARQLYDVGESGPAAQAMYGQLLAVAAYTAAMRDDRDAAWALLEQAQEPANAAGATARFNGNEIAVYRISIARTLGDYGAAVDYARKVNLKAIVAPERRARYWEDTALASQGRRRPGAAFEALLAAEHDVPEEVRYRPWAQNLTRELLSSPAAYGLTGVREYAARIGVV

SEQ ID NO: 15668 - protein, 210 aa, Actinoplanes utahensis
MKFAVLGAGNVGSALAARLTALGHHVTLAASDPGSSRLAAAAAASGADTATAADAAAAADLAVIAVPYSAVGDLFTDEVRAALAGKVVIDATNPLAADFMSLTVGHTTSAGEQIAARLPQSRVVKAFNTVFAATLGTPTLGGSAQLLPVAGDDADAKNTVIGLGNQLGFDAIDAGPLTNARYLEPTVELLIQLAYGQGLGANIGLHLARG

SEQ ID NO: 15669 - protein, 162 aa, Actinoplanes utahensis
MTQRWLDEIEMQAWVAFLDTSNLLQRRIDQQLREDGGLTQPQYELLTRLAEAPQQRMRMAELALALVTSRSGLTYQVSQLQKAGLVRREACAGDDRGVYAVLTEQGSQALHRAAPGHLRVVRENLIDLLDRDQLVTLADTLSRARAHLRMTEDDEPRRNGSS

SEQ ID NO: 15670 - protein, 332 aa, Actinoplanes utahensis
MVHRVSGETFQRVVDSALDDEHGVFVHGLSDKVPTSLVLFAHGLNGHRYKTWENFPEFLLQARTDLDVGLYGYTSGIKRYARRDMVDLGAQAQHFASQLRMLEYHRIVLVGHSMGGLLCMGAVRELLEDRLTGDDPQPAIDRISGLFLLATPLAGSLRVRWPLSWTVDGKVLRAHSDYVGGLHRTFADRVEMNGRPPSDHHKIWLPTFSASATLDRLVDKMSSRLGVPASQCTYVRGSHTSIVKPRSPGSDIFTWFCSKLDRCLVDPEGGPPPLGLRVPTQREGGQVPGGTAPKIHINITPDQMPEVVRTIAALRLEEETSIDINILPREGD

SEQ ID NO: 15671 - protein, 984 aa, Actinoplanes utahensis
MMVPPLPPPPSSWIDPRRRMVDFRKRREFLDLVTWCTEEPGIEPRVRLLAGPAGTGKTRTALELQQELQPHGWIVHLLEEPYEAIEVVGQSIGQCTKPCLIIVDNADRSPSSIRRVMEALSEQGDTPLRILLIARSAAVWWEHLTVRGPGAELLDPHPIWFRHLTAEYATEMARAAFSAVTAGLGREVAVERAPTPVALDRSTSMLHAQTSGVVAALGPTRTPGPAELLRLADPIDALLTLERRHLTKSAAVRHVTLPDDPAAVDLLLLVAWLTPRRDTDLAVTLPYRIENSLLHVDGLARLLAELYPDAGPRSHDFEPSLLRERLLEDLLLTSPHPHTLQWIMQTLARDRRHASARAVTLLSSLLLHQETAPPARFIADMGELIRADPDRVVAAAVEVAVANPKTSRIREHITLLLRSCPVHSLLALDSTIDSLARTHPPAAMTVVQQLTNAWETTGIGSEPSDRPRAVRLLNRIGIGLSEAGQVADALASARMAATLVTDMQMTNEQDHLLVADTFKLLSYRLSEMLLGKEALAASERALATFDPLQDEALEYAHLVKRVEIERSHGMRLLNLGRHEDALQWCQAAVRRAEGITGRHPIDRSRHELAAAMTDLSVALSENGAYADGYLMALQAVSIRRTLTTRNPNAFLPDHAIALSNLGLRLSEMGNLRQALATTEEAVSAWRRLATLQPETFEPELAAALNSLSLRLAENGDETGAEDAAREAERIWRRVAHNAPTYRPYLAVSLSTLAARQRAQGDSGGAYTTLEEAIQIWRSAGDKQAPRFTRRLAAALQNASIYLSESGDPEKAFASARESVRIWESAANQSRVHRAGLASAMVTYSMRAAELGHQEEAVDTITRAVRIWSVLADRIPAHRGDYATALHNLAIQMAQVGRTDDAISAAEEAVEIFQQLAGQYAEVYNLKLSSARVLCGALLATVDPDRAEQEISEAHHLVEGISARRARQNPRKLQSIRQVVQQLAG

SEQ ID NO: 15672 - protein, 136 aa, Actinoplanes utahensis
MLAIVWESSFLDRLRRQQRLTRREDPHTGVRFWTKPRVRLWTITVVSTAVLELGLIALVLANVVPDALAARVVVLVGLAVVLATILTRAVVDIMGATRHAAPALSVQRDTAGHGQGMTSAKDESSRRRDRAERTSD

SEQ ID NO: 15673 - protein, 47 aa, Actinoplanes utahensis
MRVGHVARCRSRLRSRPENSASMITLAVIANVAERLTAEISPTWRYG

SEQ ID NO: 15674 - protein, 389 aa, Actinoplanes utahensis
MPGKQLSRRIVLSAIHSLRTAIHRRSRSATKRLRQAAVPAGEAVLAATLAWFVAGHLVGHPTPVFAPSAALVVLAEARGRRLRQSIEIVLGVAAGVLVADLSVQVLGPGTATIAVVLLLTVGPMIALGASTTLIMQAAISAIYLVAVAEPRIDVMQWRCLDALIGGTLALAVSQLAVARNPLAPLVREAQQTFTGLADLLETVDAALREGDRAAADDALRRARAARTRVERLGIEVLAAAEAVKLRVGRRRYVHQVGQVEATAAELDRVVDNIWVLARNAVTLIRLDVPAPTELSRAFGALAAAIRAAGEALATDLTGTDDPQQHASRADHTALEAVRIAAKLLESEPALPLTMIIGQIRATAIDLLRGVGHDDEILDRVDEAVGLTAP

SEQ ID NO: 15675 - protein, 139 aa, Actinoplanes utahensis
MAAASRHSRRTRLALVPLAALAAATAAATLAPTPAAAAVKNSCTISGCTAAENAYEGWSELGWPISRGWYSWSSGKCSYAGGEYYNNNGQLPYGDTFWEYDVYPRNCGAHRDAYRIVVDGDTGQAWYSPDHYSDFHEFR

SEQ ID NO: 15676 - protein, 354 aa, Actinoplanes utahensis
MNSLNSWLLLLIFVACAAAIWVSGIKLSNATDVLSERLHLGTALGGVILLAIATNLPELAITASAALSHQLDVAVGNILGGIALQTVVLVILDAAGVRPRKPLTYLAASLTLLLEGALVVALLLVVVMSTQLPPSLIAFRLTPGAVLIAVLWGFGLLLLRRAGKGLPWHEGGDAPDTQEGPQGHSKTTKENQASAKGVSTGRAATVFGIAAAITLVAGVFIERSGEELFGRLGMSGVLFGATVLAAATALPEVSTGLTSTRMGDYQLAISDIFGGNAFLPVLFLLATVLSGQAVLPRAHHSDIYLTALGGLLTVVYMVGLVFRPQRQRLRMGADSLTVLILYALGIAGLAFITG

SEQ ID NO: 15677 - protein, 182 aa, Actinoplanes utahensis
MEGRSRSDEVDADLVEAFLTASRALVGVAVRSLNAGDGEVTLPQHRALVLLAAHGPQRMADLAALLGVNSSTATRQCDRLQRHGLIRRKPSPQDRRAVCVSLTEAGQELVRQVTAARRAQISAILQNMPLRNRKDLVAALLGFAAAAGEVPDQNWSLGWGTDTAPDRPSPAAPVPPTRGTVK

SEQ ID NO: 15678 - protein, 119 aa, Actinoplanes utahensis
MGKVLVVDDEPDLRFLHRRILSRAGHEVTEAGDGASALEAVRTSPPDLVVTDMMMPVMGGVEFIRRLRADPATATIPVLAVSGDWQLATEADAALAKPCHSQDLLAAAEDLLRKGCGGR

SEQ ID NO: 15679 - protein, 506 aa, Actinoplanes utahensis
MPQPGPARSSRGPATERMWWEVTRLSTGQADLDLVLGGGFERGSMVVLSGPPGAGKTILAQQICFAAANADHKAVYYTTWSEPHSKLVEHLREFTFFAPERLGPQVEYVHLGNLLRDSAGNDLSPMIDEVIRKAFDDRPAVVAIDSTKMLRDFVSEHDMRMSLYDLGSKVAHSGAVLLLLGEYTSEEEQTGAEFTLADAIMQLSYRPREPVDRRGLRVVKMRGTGHLQGTHTVHITRDGLRVYPRIESMLPEEVAPQQERISTGISGLDALLGGGVPRGDATLVFGPSGVGKTIGSLHFVADGLARDERCLYISFQDTAEELIGIADRLGWDFTAAREAGKLTISHVPVGNLDLDGLSSVARHQLAEAGTTRIVIDSLAEMAFTAREAERFPAYLRSLLGLIRTAGASLWVTSETRTIGPMEEPLAGLMFLFHNVIQIRYIELCSEIGRAVNILKMRNSGHDSALHTYHVTDTGAAVGDKIENVTGLLGWSALRHCPPTSPRDDGN

SEQ ID NO: 15680 - protein, 225 aa, Actinoplanes utahensis
MTDTGTPKPAGNRWGRYALSAAVLVLSLTGVTALVKGGQDQPRRIPLAAAASAPETALPAAGNGELTSGPLMSTSKPTRVVIPALDVDVPLTGLGRQADGTMQVPTDARTVGWYTGAPTPGSLGPAVLAGHVDYRKQPGTFHRLTDLKPGDSIDVDREDGSVAMFAVVKVERYAKAEFPTDAVYGAINRAGLRLITCGGDFDSTAGHYEDNIVVYADLTMAHPAG

SEQ ID NO: 15681 - protein, 259 aa, Actinoplanes utahensis
MKLPRALLAVPAAAVVLLAVPSAAFADESVHVKLDPLNHSGASGTAILTAMADGDLKISIRSIGLVPNSPHAQHLHGSTEGMDFHCPDMSADSDGNGYVSTEEGMPDYGNIFISLTTKGDTSPKSGLAVDRMPVADAKGNLSYDRTIPAADLPAGTIEHLKDLHVVEHGIDANRNGKYDMDGLGESTLAKSAGLSGIPEEATDPAVCGMVSGAAVGSVPVGGVATGDGSTRHDSIPLYALGGIALFGAAGALVARRRLS

SEQ ID NO: 15682 - protein, 542 aa, Actinoplanes utahensis
MGPEEDGAAGQQAGDLVVADRYRLLALAGSGGMGRVWRAHDDLLDREVAVKEVLAPAALPYMDRTEILRNTVREARAAARLDHPNVIRVFDVVRAAGRSWIVMEYVPSRSLHDIVTRDGPLTHRHAARIGATLLDALDAAHRAGVLHLDVKPHNVLIAEDGRVVLTDFGLATIVAVPAGRAEPLLGSPHYIAPERLRDGVSSREADLWSLGATLYMAVEGRAPYARPQVAESLAALLHQPPDPPQHPGPLHTVIAGLLTADPKRRLTAGDARPALRDLTRRAVGVHAVPAPRRPADSDVRFRAAAAPAVAALIAEPVAKPAPARWRGLLVAGIATAAVILVAAVAVRIYGGGTGTPPAAAAVASPMDACSTAQSSPVTGSGEDAPVSLPDGWLWHVDADGFALAVPRGWHRGAAGGDVCFRDADGDRSFTVQSAGPLNGRPLQRWQDAERKAPPGYRRVSMGPLLITGGGADWEYSWQPATGPRLHTYRMLLAAGDDRSYALTWTTRDADWDLDRSILRTLTDGFRDSARPAVTWTIPGPRH

SEQ ID NO: 15683 - protein, 230 aa, Actinoplanes utahensis
MFDINRRRSGRAGRARRWAVPVAAAAVILAAGGGLVAKAASAAEAGGRGPDEFGMTMGSHAGHSSGFTYHHGFYCDTHIAAASTTGCEAGVAAEVAPARHFDPLFITVPLGFTVKGLDCPDKLTCVDHPMSLDMTRLAPALDPVYKATPEKLMPALRDFTTPGHDHFIGTRNGGKAEWWDVRVVGVTDPATYRAIRKHQSWTYLDGQIKAKNKHLVGPIPTNMFLFFAAH

SEQ ID NO: 15684 - protein, 500 aa, Actinoplanes utahensis
MRRTLLGAISGIVAAGSGVAVAELLAAATRPGAGPLVAVGGAVIDATPTPWKEFAVRELGTNDKPVLLAVIGVVLAGLALATGIAATRWRAAIPVGTALLGAVGAAAALSRPTATLPDAVPAVVGAAVAGVLLWWLLRKPRPVDTGVRENGVDRRLVLRLSLLAAGASVVEGSALAVSGQRQNAAGQSREALRLPAAADPAKPLPGGIGRDFTTGNTAFYRVDTALTVPRIDPSTWSLRIHGMVDREIEMSFAELLRRPLIERDITLNCVSNEVGGPYIGTARWLGVPLAALLREAGVQSGADQIVARSDEGMTIGTPVATALDGRDTMLAVGMNGEPLPLEHGFPVRMLTPGLYGYAGACKWVTEIELTTFDRFDAYWVKRGWGVQGTVKTASRIDKPKPFARMTAGPVTVAGVAWAQRRGIAAVEVSVDGGPWQPAELLPTASIDTWVQWRFTWKATPGPHSLAVRATDSKGAVQPQDRATPFPDGATGWHTISVTVS

SEQ ID NO: 15685 - protein, 214 aa, Actinoplanes utahensis
MRATKFTALAATTVFAISLAACGSNSDDSSGDTAAAAPMATTAPTSVAPSMGTSMVNFGPGCAAVPTDPANAGSFEAMGKVPVATAASGNPLLSTLVAAVKKAGLVDSLNSADGITVFAPTNDAFAKIPKATLDKVLADKKTLTSILTYHVVSGKLTPADLAGPHKTLQGQDLTVAGSGESFTVGTGKASVICGNVQTANANVYIVDSVLMPKS

SEQ ID NO: 15686 - protein, 152 aa, Actinoplanes utahensis
MKKSLRVATTLGAMALGLGVTASPALAGKPGTPDHAPCRQSAMNGYGTKHHHKHPTTNGGAAAANNNTGYGAGSKHHHKHPTTNGGAAAANNNTGYGTGSKHHTTGSGAAAANNNTGYGTGSKHHHKHPATNGGAAAANNSTGGYTGGHAAG

SEQ ID NO: 15687 - protein, 697 aa, Actinoplanes utahensis
MAEPVNEVSWEALFRAVPTPLLVLDTDLMIVEANQAYLTATMRSRTELVGRPVFEAFPDNPEDAAASGVTMWGASLQRVLSQCTTDVMAIQRYDIPRPWGGFDTRYWAPANAPVFGPDGELRWIIHRTEDVTAFMQARHNDPAALAELTEQLRIRTEQMATEVFARRELEEQNESLHALLDSLDTAVVGCDAEGRTVLRNEAARQLFGALLDQVPVQRWAEYQHVFHPDGHRMSGDDIPLMRALRGERVRDAEIVVRVPEAPRRYFRANGRPVAGHPRLAAVVALHEITLHRRAARFKECELELSRLTSKPAPPDEIFAEMVQLISRMAGWAAVEFWTVDDVARVLYRTTCWAEPGYDLPCRLPDPLSYGQGVPGRAWQTSDPIWAANLPTDPDAAQQATDWGPLRAALAIPIPSGSVILGVLVCYSDVPETPDDTRTAMMTGIGAHIGEFLSRRRAERLTEELDRSRDEYIALVGHELRTPLTSLQAYTDVMIDEPDLSVDERQSMLKVMQRNTASLRAIVTKLLDVAGMRSGHVDLHRQPMDLATIVHEAADDARTGAQITIEVNTPPQAPLHGDPARLRQVVDELLSNALTWAPRGSAIGINLRADPRAIAVSVSNTGRPLTVEERGRLFDTFFRGESARNGGVPGTGLGLTIARTIVEEHGGTIAVSEPDEAATTFTIRLPTHQPAPNDSLTA

SEQ ID NO: 15688 - protein, 407 aa, Actinoplanes utahensis
MIPVRAIADQAQTAALARYHLFDGPPEPDLQTVVELAAQLCQVPISVLFVIDADSQHQVAAVGIDTEVCRREDSMCSVAMAAPDPMFIEDARTDPRFVANPFVTGRFQRFRFYGSTQLRPPEGFVLGTLCVFDEVPRVLDEQQRQGLDRLARMAIDVLELRRHGFLVADLLRRQQQIQAALEGTNETLRHFAAQLAHDLRNPLTGISAYAAELHLMPTVNADADASLCTDRISAAALRMGTLIDDVLAHATTDHARHAVEVNLTEITNEVLDDLAVQISEANADVTVNDLPTVIGDRTQWHILLQNLVSNAVKYRHAERACHIAITAADDPAGYRVCVTDNGIGIPASQREQAAQPFTRLSPGHSTGHGIGLSTCARIVHTHGGRLDISDTPGGGTTVCITMPTDNR

SEQ ID NO: 15689 - protein, 459 aa, Actinoplanes utahensis
MSTNVRGFLAQHRDAVVAELAEWVRIPSVAGVPEHAVDLQRSANWLAAALRETGFPSVEVWDTEGGPAVYAQWCAEPGAPTVLIYSHHDVRAAKDEEWDETAPFDPKVRDGYLYGRGASDAKGQALAHLWGVRAHLAATGRDHPAVNLKLLVEGEEETGSAHLRQLLQDNGDRVGADLIVFSDTLLWRSDHPAVCVSMRGTMLAKLEIMGPLQDVHSGAVSGPAPNPVLEMSRLLAQLHDDKGRITVPGFYDSVVEPSQRFRDELAALPYSDADWLKRSLTRSVGGEAGYTVLERLWTRPAIEVTSMISGDPIGPSRAAVPSLATADLSIRYVCDQTGAEIAEQLRRWVADTVSERFDHRLTVSPETAQDPYRTPDDLPAVAALAEAMQEGFGRPAGRMGNAGGGPAVWLTQSVGAPVVYFGTGLPEDRWHDSNERVSIDVLLSGAATLAAFWDRLPSA

SEQ ID NO: 15690 - protein, 83 aa, Actinoplanes utahensis
MPAHDRALNGDGDQPGCGAGPDGRCVWAMAFKLIEAAQQRWRAVDAPHLVARIRAGTLAGRAYGRVAGDAYEEAPMRVTSTAS

SEQ ID NO: 15691 - protein, 113 aa, Actinoplanes utahensis
MKVFKLAVGFAAGYVLGTRAGREKFEQIAAATRKASNHPAVIQAQDKAKAMLATGRDSIMAKLPHDDTATASTPSTTYPTQTTATTAAVGTPSRPRPSKAAHTPSPVGGDPLP

SEQ ID NO: 15692 - protein, 254 aa, Actinoplanes utahensis
MLKRDYRPLIVLPHAGAFGLRQLPAALMMEAAFTESPDAATTSPSPSSDPGRVDDTSTVPGEATRSPSPRPDDRASTFPGPTRTSPAQPTVPPGGVEWVPARPGEKGPERLSAREAYRRQLDAVEPLHRSGQTRVRKQKPARTPNRSATQEDEIGVEVRATISLYSLRGVIVRLYWSMSSRNPQEKLSVGWSNRLLEPALKATSDHDTASFTFWLPMPGTAKGPFVVTSSLVVSDDEPPLATADTEPFSWRQSG

SEQ ID NO: 15693 - protein, 617 aa, Actinoplanes utahensis
MVTDHLLVLVFTVMILVAATSMALHPDAGRLNRLIESVALGARTLAVIWLVATRGRARHPWTIATLLLVDITLLAAVFATIPIPYAREPFVLHSVMRLPLVCAALRRRQMMVVLPALLAGPSVILGWQMFTLGRNGITMPLLWLVTVGVTGYCMRRLAQHLATARAEALELAARRQHDALHDSLTGLPNRFLYADQLAEAVTAAAPDGPDVAVVLIDLDRFKMVNDSHGHQFGDEVLVAVSRRLRHSLRSGDTLARLGGDEFAVILRDIHEPADALAAAAHLGAALRDPLHPGGAGASPGTGPGMYVTASMGIAFARRHRDDLGAVLREADIAMYQAKARGQASVEIFDETMGRVAHRRLDLENQLRHDVETGSDTLSVAFQPIVEPAGGRIVGMEALARWSSPRYGAVPPDEFIAIAEECDIIHDLGRRVLRTALDHTLWWCTLQPTLEISVNVSPVQLHRPEFADEVRALLRQTRVPAEQVCLEITEGVLLDPYGASDANLRALHEAGLKLAVDDFGSGYSSLAQLRRFPVDKLKADRSFIDDAPLLQAVADLALALNAQALAEGVETPEQRRRLVELGYAQAQGYFFARPQPPAAVTELLRSQQNQQQGSSGRT

SEQ ID NO: 15694 - protein, 178 aa, Actinoplanes utahensis
MNNTDPEALTDVELRQRAATAGVTAPTGMPRADLIAALQNTDDAMTRSEERLVPSTQVYETGRARLRKYVVTEDVQITVQIRREELRLEQEAIAAPDQRVVADPDVFGPDEVFTGPDGGLIFEVTLHEERPVITTEIVPVQRVRLTKIVHTDEHIVSGQVRKEKIDVDLPGEPPTTLQ

SEQ ID NO: 15695 - protein, 257 aa, Actinoplanes utahensis
MITQNDIARLDDTDVYDTTGDKIGSVGQVYLDGRSGDPEWVTVKTGLFGTKQTFVPLRDATFADDRVVVAYTKAQVKDAPRIDADGPISHAEENELYSFYGLPSTGGYGDGYQNDDTYQSGARRRATTDHAGDDAMTRSEERLVTDTRTEQAGKARLRKYVVTEQQQVTVPVTHEEARLEREPITDANIGDAYDGPAITEAEHEVTLHAERPVTNTETVPVERVRLSKETVRDEETVSGEVRKEQIEYDGPDGTNRL

SEQ ID NO: 15696 - protein, 253 aa, Actinoplanes utahensis
MTRDPDTPPTAGDPAIAAGHPVTGRSGLDQHRILSAAVQFIDENGLRRLTMQRLGAYLGVEAMALYRYVPGREALLDGVVETVVDELYGDPDVHLQAQGGWVDYLQRLAHGLRRIALAHPEVFPLVATRPAAAPWVRPPLRSLRWIESLLEVMTEAGFSDENAAAVYRAFSSFLLGYLLLEVSARGVETGPVEEPDVSPIEDLSEYPMVQRLQPHLSVDAAAEDFEEALEALLDRVALLLPRRRRPPRLTENM

SEQ ID NO: 15697 - protein, 349 aa, Actinoplanes utahensis
MSADHHRDRRDAVATTRTGDDKPYDLSAPPPDAGPDSPVELRGKGLVGALKRTGKQFSQDNLSDWAAALTYYGVLSIFPGLLVIVSLLGMLNSNGQKTVQDAVHQLAPNPQLQDMVNTVLTQVQDPGKAGLAAIIGVLVAFWSASGYTAAFMRASNAVYDVPEGRPIWKTLPIRVGVTAVVGIMLVVSAAIVIFTGDLARIVGDKIGLGSAAVATWNIAKWPVLLVLISLMFAILYWASPNAKTGSFRWVSPGGLFAVLLWILASVAFALYLANFANYNKTYGTLGGVIAFLVWMWISNIAILLGAELDAELQRGRAIAAGHDPADEPFLELRDDRKIKPGSEQGLSTN

SEQ ID NO: 15698 - protein, 139 aa, Actinoplanes utahensis
MSERIAQGSAASTGDLVSQAAAQISTLVRDELALAKLELTEKGKRAGIGGGLFGGAAVLGLYGLGLLVALAVVLLDLVWPLWLALLVVLVVVLAAAGIAALLGRNKLKDAVPPVPSDAVASAQADVRAVKNAVQEGKSR

SEQ ID NO: 15699 - protein, 119 aa, Actinoplanes utahensis
MSQSPTPTDPQELRAEIERTRAELGQTVEQLAAKADVKTRAKQAVADAAGQAQHKLAGAKDQAVQAAGLVKGKALTAKQQLADSDLPAPMRRPVPLAAIVAAAAALIITVVVVVRRRSS

SEQ ID NO: 15700 - protein, 90 aa, Actinoplanes utahensis
MSSKTLKIAYKPVGLLLGAGAGAVSGLIFKQVWKLIAHDDDAPDATDQDRGWTEVLVAAAIQGAIFAVVKAAVDRAGATGVQKATGQWPD

SEQ ID NO: 15701 - protein, 514 aa, Actinoplanes utahensis
MPWFGRRRQQTPEARPVPRDVEALERVIEALAGGAASVQDGRAKITSTLVQVLGLDYGALWSCNERGDYTLTFETGSLGPALRGAIGGTDTLTSADGLIGAAVTGRQAITLSETPQAGSSCLRWQAAHRAGMVEAASIPIVHDGTVAGVLEFYGRQPLPAFASDKWAAITRIAVLTGLHAAAASELKETLSDRAAVTNVVAEVGEALDQQSAIRIALDRVRTAFGWAYGSYWALDEADQVLRFTCESGSAGDEFRKVTLAASFAEGVGLSGRAWRAKDLVFVHDLAEMTDCVRAPAAQRAGVRSGVCFPIMDGRTVIGTMDFFTTESIELSDSRAAALRNVQQLVSQRMSALRRVENDAAKARQLLDTVSELRAASEDASRVAALAASGSQAMTTEVQALSHASAAVGDVIKIISSIAEQTNLLALNATIEAARAGEVGKGFAVVASEVKDLARETAEATQKVTEQIAGIQNSSRAVAEGIHTSSDTIGQLDIVQARMNQVLQRQADMASAFRS

SEQ ID NO: 15702 - protein, 112 aa, Actinoplanes utahensis
MSSMPPRHPVTITMGGIDDGTVHLTVAGEIDLATADVVYDAIAAAADTPAAQHVEINLRHVEFCDSTGIGALMRARHFALEHAVTLHVVEPSGFVRRVLELAGVLEILTEPK

SEQ ID NO: 15703 - protein, 182 aa, Actinoplanes utahensis
MNVLVAELKIRARLCLNAARRGDFGLLGHLPADGGRGPSPAPGWRLRHCLTLVAKNVGFAGWDHARRVLGGDAQIGDDLGTFWHAPRCTGLLSHWFPSYSQAQVFLADTDKLVLLPYRRQFVVVDHDYLAAIGIPHAVEPGRPGRRDLVAAYGTPDWLALAQQRLHATRTPGPSSRKGGRDR

SEQ ID NO: 15704 - protein, 262 aa, Actinoplanes utahensis
MSSLSPLAVVTGAGSGIGYALTQALLARGLEVVAIDRDTSRLDERVQAYEFDVRDGAAMQRLAESLSTRPVHYLFANAGVGVSGDVLSSPEQAWQWAWDVNVLSVIRSLRLWWPQLVAGRGKAVVTVSAAALQSYPGAGPYRATKAALLSALEGLYYEALSDGVGVHALCPGLVRTGITDVNRYAEVAHAAPTEPNAFESFMRTAMRDAEPADAFARRVLHGLDSGAPFYWFTHPETMGWTEARHRAVVSAGTPFADFGTPA

SEQ ID NO: 15705 - protein, 537 aa, Actinoplanes utahensis
MGLRWEPNRGTSTAVAPGTGAAAALELTRGQMTQTAADRMAAVTARAAQARCAMIHITDGQNLRLIGGQAIPAGFDNRKPVPVTSTLAGLVLHTGFPVTINDIHTDIRVPLDAPVRSTRLRCYAGFPVRDPDGHIVGVCAVADELARDWLPEQLAGADEGAQACTALVAEHLARESELRQRVFLDTLLDSLDTGVAACDADGRLVLVNRSLRERLELTDVDGTAEEWVARLPATDTTGTPLSPDRTSLLRALRGETVRGAENFLQVQGQRHLFRVNGHPITYGDQQLGAVAVFHDITAARHAERLQQMLSRTKDDYLNLVGHELRTPVAIIDSYLDLLHDSVHDTAPADLVPMIEAARRGSERLRRLITALLDLSALDAGRSPLQMSDIDLSTVVTAAVDHVTERAAKRNITITCHVPPHTPQHADYHRMRQLILALLDNAIAYTPAGGTVTVTLTSTSQADELTVSDTGFGIPAYEQPHVFERFFRGALATELAIPGAGLGLTIARLITERHDGTITVTTNAPQARGTSVHVRLPH

SEQ ID NO: 15706 - protein, 142 aa, Actinoplanes utahensis
MIVVDDGSSDDTAAIVERLGLARVRVIRQPNAVKPAALNTGIRHSRGQILVLVDGDTVFAPDAVGRLIQPLTVPGVGAVSGNTKVANRTGLLGRWQHLEYVIGFNLDRRMFDGYDGCIWLHQGGLNWPHPRGTFPHGWATTA

SEQ ID NO: 15707 - protein, 546 aa, Actinoplanes utahensis
MPLTKDELFRRIRSDAVLEELSIRALARKHGVHRRLVREALTSAEPTPRRQPVRRSPRLDPVKKTIDEWLRADLEAPRKQRHTARRIKDRLAEEADTDVPYSTVRDYVSMRRRQIAAEAGAPMDGFIIRHNRPGADAEVDFGEVVVCLAGTMTRCHLFAFRLAYSGLAVHRVTVSCGQEAFLEGHEYAFELIGGIPVGQIRYDNLSSAVRRVVFRSRSRVENPRWEAFREHYGFTAFYCIPGLEGAHEKGGVEGQVGYYRRNRLTPVPVVATLEDLNQRLAAADLTDRERKIRLRSRTVGEDFAAEAALLGRLPTEKFGASLTLRPRVDREATVTVRMNDYSVPARFIGRKLQVLLGTTEVVVSDGRTEVARHPRLPGRGGQHLLLDHYLEILLRKPGALARSEALDQARREGTFTAEHEAFWTAAKAATGEDAAGTRELIQVLLLHRHMRGQDVAAGIRAALSVGTATADVVAVEARKAAQNAGRSPTITAGPPPAPPPPLPPPAPPPVTERTLQRVARLPADHRPPPDLNRWDQLLHHRRKESS

SEQ ID NO: 15708 - protein, 263 aa, Actinoplanes utahensis
MSRIPRAITENAADAAIETSCRVLHLPTVRSQFSELITRAERDQLSYRGMLAELLMAECEERDRRRSQRRLQAAGFPRQKWLSDFDYTANPNINAALINNLANCDWVRAGQPLCLIGDSGTGKSHLLIGLGSAAAMAGFRVRYTLAAKLVNELVEAADDRQLTKTIARYGRVDLLCIDELGYLELDRRGAEMLFQVLTEREEKNSVAIASNESFSGWTRTFTDPRLCAAIVDRLTFNGTIVETGTDSYRLSRTAAKQPATSGS

SEQ ID NO: 15709 - protein, 262 aa, Actinoplanes utahensis
MGPLQAALVEPLQTVTLAAGGASSSRPGGARYNRHSQFEIARCMPTVPGAIGAFRRAAIQDAGGVSAQTLAEDTDFTMSILRAGWDVVYEPAAIAWTEAPANFRQLWRQRYRWCYGTMQAMWKHRDTVRQRGPAGRLGRRGIGYLLPFQVLLPITAPMIDVYGVYGLIFLSPLTVAAVWSAFMAAQMATAAIALRMDGESYRPLWTLPLQQIVYRQLMYLVVIQSTVMALIGSRLRWHRMVRIGAAQQHATGVRASAAAKSS

SEQ ID NO: 15710 - protein, 598 aa, Actinoplanes utahensis
MEAAGDAVLYRRVLSPGAHRTLMGVAALHIVLAVALVVYLVLPGNLPRFASVTAVGQVVMAAGLGLMIVLQLIVALRTWVLAYFAARAVDPVPVKAKPGLRVAVLTTIVPGKEPVDLVMATLRAMLRIRHDGPLDVWLLDEGDDPEVARLCAEIGVRHFSRKGHPEWNQDSGPFRRKTKHGNHNAWRSMHEADYDVVAQMDPDHVPYPNFLERTLGYFRDPDTAFVVAPQVYANLGDSFVARGAAELAYVFHGIMQRGGNGHGAPLLIGTNHLYRPAAFAQIGGYQDCIIEDHLTSMVVYSAVNQGTGNHWRGVYTPDILAVGEGPATYSDFFSQQKRWAYGIWEIARRHSPALLRRLPRRAQRLAFFALQSHYPTTAASWVIGLALSAIYLVGGVSVTRLPALVWGVLFVANLAVGLGFFRITQRYNLVEHERRSWGLTGMALELMTAPVYVAAAAAQLAGRPLAYVVTAKGKAATGDTWRTFRPHLGWAAVAAACMSAGLLLHHDWWSLYLWAGISLLTCLAPLTLVALNGVGRRFRGAAATITGRRRIGEQLVRQGLLSRQELEELLALQAGAGRGTRLGDLAVQHGYVPADRLI

SEQ ID NO: 15711 - protein, 128 aa, Actinoplanes utahensis
MVTARLSAQRSRTEAKRLRPSYAASANRRMDEHRGQAVLAHRWAPITGELPVTVSIGVTAAVPSGTVQGAACRSRAVPAGDRVHAKLSQPSGHQAAFRGGETAAAKTFTLPGSLPITYAHMRNRMGDA

SEQ ID NO: 15712 - protein, 517 aa, Actinoplanes utahensis
MRKFHTGPGIVAGRWRGVAGMTAIWVAFLGATLASSPGDLVRYVLDDGVYPLGVVVAAVMSLFALRRGPRERRQWWALTLAGNVAWATADGYWCWNDAWQHPVDGVSIGDALLILSYLLQLIAIGGAFAGSGGLRQWRGQLDGALVATAVGLAGWQLMVSPRLHTGLTANSVVLAVYPLLDVAFFMVFVSVGLSGRRRLPLPVLLVVIGNLWSVLGDLAVAVAGLRNLTLDDGLVKAVYLPMILLMILGATIDARRSTAEQAVERSLAYDPGNVPVLVAVAGVLLWAGRDALAGRIGAAALIASATMIIGLTVRSHLTLRDHRRVARELDAALAEQRRLAITDGLTGIYNRRFGEELLQLESERAVREAGSVSIVLVDLDHFKSVNDTYGHEAGDAVLIQSTVRFNAVLRSTDVLIRWGGEEFLAVLPGMDGHEAAEVGERLRRVLSDRPLQLPSGQRIGATASFGIASVTTATFPPEAVLQAADEALYAAKTAGRNRVVRAGAAAGQPDLSACPAA

SEQ ID NO: 15713 - protein, 436 aa, Actinoplanes utahensis
MKSFLMRTTLTKAHQISLAIIVGLLVVPTVVSGWQLWSATKKIDYVAQVGVPGAHLIGSIDGLMNKYRKEQWQYLALHPGDPQLAECTDSMTDEKAEMLGLFAAYRQLPLQQRGREELATFQADWRDYVDVTANELTLADSGQYQAAIDTFNTGHGQAKWDSLKKDLAAWRANDVAVASAYRATARQWARWSVAAIVVLLTAALLLTIKVSRLLKTRLTRGLRRLSAAAGGIAAGEVDQQIEVDADDEIAEVARAFADMVTYLRGVVNTMQDQAQQLATMAHHDALTGLPNRRAWDLAIADGLKAAHRSGAQLCVAVIDIDHFKSYNDTHGHPAGDALLRTAAKAWRAVLHPSHLLARYGGEEFTIMTSNATVDQVVAIVARLRTATPSGQTFSAGIAVWDGSETGEQLVRRADDALYRAKHAGRDQAQVAELATR

SEQ ID NO: 15714 - protein, 576 aa, Actinoplanes utahensis
MSLAVISTLAAALSPFLVRSMAVVKEQREREVAVQLADDAMERVSALTGAAALTGRGYAAARTQWDAATSSSTPASYAAAVGPYLQSMSLGNPLDVSDPAKAPWLAWDLDLPVSATAGASAGLPTAVINAPVNGLSFQENYYLGMCRQQFGTGGSCDNPDTPDPDITRADVPLLRVVIAVTWTNHSCAGGICTYVTSGLVSDVQDPTYNLNRPAPTANDPGPQVSYAKLAITGLQLSATGGQLPLAWSFTGLPPGLTGSATGLVTGTPTDPGTGKTYPVTATVTDQLGRSSSVTFSWTIVPAPVVANPGNQSTQTGTATSLTMAATGGANPITWSATGLPAGLSINAGTGIISGTPTATSRLDATVTVTATDKMGRSTSVSFTWTVTALALAPIATRTDSIRDSVNFTVPRPTGGTGPYTYRMVNYPGDYSGEISINPSTGVISGKVWYANRFFTTVYVKDATGTEVSTTFLWNVLPSQPNDLYITVPNPSNPDQTSKVGQPLELDAYAPSGSNSGYDWVTYTTGLPPGLSIATKNYYYGAITGTPTTPGVYRVTLVCQDANYKRAVVMFDWTVTP

SEQ ID NO: 15715 - protein, 218 aa, Actinoplanes utahensis
MIRRQICSRMGDDSGTSLIEVMVAMGVMSVVMAIFTGGVIQFYRSADAAEETGITQTQLRLAFQTLDREVRYANGISLPATAAINGAWYVEFSGIDPAGAQVCRQLRLDAGGVLQELTWTPGSPPAAGTRGRTLASGLMSPGGSVPAPFDRQAAGSTPYASASTSATGTAFSPDLQRLRVRLTTRAGSTTSVTDVTFTALNTSRDTADPNICLEGRPS

SEQ ID NO: 15716 - protein, 496 aa, Actinoplanes utahensis
MIQLRGDDRGSMPLAMLLSIVGVTLSTLVGTVAVSQITEARTSSDRAQALIAAQAGITVATGQFRAATDSTGTGDPARLPAGPLAGNVGPNGGGRYQVTIAYRDLDGNPLTVPLNAQPATAVVVSTGIQAATGAFQQGTNGTRTLQATYAFRLSNQNIPGGQIHVRSSAADLCLDAGSAQPVAGTPVQMRSCSGVPAPQIWAYNSDLTISLVSSRTGINPLGMCLDAGSPHTAGAQVKMQKCTATSPPPPQQQWSTNDSANIMGTSNGSTLDNYCFNVQSPDFAGSFVVLSNTKCNGNYDNVQTFQPDPAVGAGAAGPATRQLVNYRQFGRCLDVTNQNVASTYLIAWPCKQAPNPANISWNQKWTLPPAVNGAHTATGRIYTTLNGTEYCLRSPGVTSGAYPTMTTCTSTSSTADQTWTVYGNTGSYTASYQIVDNAGLCLAPADPTAYPTEVLPYTGPTVSRIVLRTCDGSAWQKWNAPPDVSKPSPLKQITER

SEQ ID NO: 15717 - protein, 232 aa, Actinoplanes utahensis
MKAITMQLNHIVRGAASIALGVSVALALTAPAWAGRSKDPAGANGTVKIDAVPFDPKISNNPHVTCEFRVKFFNFDTNEHGNIVFTAQPPSGKGTELLRQNNVLLSDDAAKGGAPDPDEIYTYSAGDLKLDGLKLQPKQGYHIKLTVERIGAPGAGKHKVFWLQPCASQNGGGSSSTPASAPSSSSSNPVPAGNESALPITGSAASTVAAVGLVLIGSGAALTIRRRRKFTA

SEQ ID NO: 15718 - protein, 240 aa, Actinoplanes utahensis
MRSTGPRRRPTRTLLLSVRASLGRLFHNTMTSTSVPPSNRWRRALLAGAAACAAALLSACSDTTTAGPAGAPESSPATTGASTAAFNAADITFVQQMIPHHRSAITMAALAAGHAGDPRVTQLATAIKAAQQPEIDTMNRWLRAWGKPMPSAGSDAGEGMEHGDMAGIDELDMTALMNAKGAPWDKQFLGVMVKHHQGAVTMAEQELAQGVNTDARTLAQKIITDQQAQITAMKQIRASL

SEQ ID NO: 15719 - protein, 223 aa, Actinoplanes utahensis
MLRTSMLSSPTWRRGLLAGAAVTATLVLSACGGNDTSSDSGMNHGGMPTTTTASAAATATFNDADVMFASMMIPHHQQAVEMAALADGRAASSEVKDLAAKIKAAQQPEIDTMTQWLSAWGHPMPMSSSGMPGMDASAMPGMDHGAMPGAMSPADMGALGKAKGAAFDKQFLTMMISHHEGAVSMAEQEVAQGSNAGAKALAEKIIAAQQAEITTMKGLLSKG

SEQ ID NO: 15720 - protein, 149 aa, Actinoplanes utahensis
MGAVIGATAAGIGRGARTVLLLCTVFGLAVMHTLGHAGVRVQDRGPVSMTAMSAVVSVPVVAFVAAAMSGECPDDHCPGDHDHGHGAWSVCLAVLGGLAVVILLAMMLLAVARPGLFPGGLGASQRRASRAPPPTGTGLTLASAAVLRI

SEQ ID NO: 15721 - protein, 183 aa, Actinoplanes utahensis
MRFGAQDAVRADDLAADGEGRGGRPMTLTRRFTDALGAARPRVGHRRMAAGVLLATAILQAVSPLFVGFDQGEANDPVLVPPGPFFGIWGVVIAGSVAHAVWGLADRRSAVDPYRSVQLPLSLVHVLVAAWLLAAEHAPWATLPIFAIMVAVLVACLRAVLASSEIPRATRWLLGGTVGIYAG

SEQ ID NO: 15722 - protein, 76 aa, Actinoplanes utahensis
MQASAIAAAAAMSCIIIGFIGGWPPYVAAAAWALTGVTLSGVRFHTPAIWATAAVGLLAVALTTQRSIKSGHRPGT

SEQ ID NO: 15723 - protein, 52 aa, Actinoplanes utahensis
MAGRKLIDSRPAGAEPRLLTGDHALLGALDGVANQLPPVVADLRPGLMGRPA

SEQ ID NO: 15724 - protein, 149 aa, Actinoplanes utahensis
MDQPLVVVAEDDRDVRDLLTFFLEKAGYRTIGAHDGATAARLLTTTRPAALITDVHMPDMNGMDLCRLARRTFATQDIPIIMFSANTHQHDMQAGITAGADSYLPKPLSPSAVVSRLDELLSAGGLRRRDDVPAHTRAAVGGVFTLAGS

SEQ ID NO: 15725 - protein, 259 aa, Actinoplanes utahensis
MRLAVKAQAGGRDFGRTYSSSAQGDSNQAHDADAGITLEHRKRSSQPLTGLSESAQPVGKTLRRRRAKTAPASRLVVLLVEDDPDNREITAAQLTSHGMQVICAANAAEAVAACGAHTGPIHVLLTDVHLPGASGGELTNLITVLRPRIRTVYLSGIPADLATRSYRLDTRAPFLTKPYSSDLLVNTIRHVAAGIAEVVNEDCQCATSKPTGSQNEKCHPHGASAQDRAPDQGMRWPRRKIATPRRRAPQPRRKAHGSR

SEQ ID NO: 15726 - protein, 528 aa, Actinoplanes utahensis
MAPTPALPVPITHIGPLRHLAVHPHRLYSLGRFDEALTVVEKNRWIAEALGDSDTARSVLQTRLYVLTELGRLAEAETLGWHLLDHAASRVAQAKASADLADVLVRMGRLEEGLHLLAAALNILEGCPRDWRYFAAMSSVVEAARWADLYELSDAAAVADPRWLSADPILDGQRAEMLLEWALRLEHVGCQDEATARYQSVIALTRPWVDPGTTTGPDADRALVSAVLACALAKTGAIAEAIELAEAVIPVLRSEGRLFDARLAHLAYGVALRNRGEYEAATRELIAAEQSCAGSGTSAGAPRHRLIFQFELALVDLEAEPGSASGRLLSALRGHAEQLWRLRMDRVAMLRQARHRLRLEAAHASADAAAQTDPLTGLANRRGFDRRLATVDTDPQAATDPLCLLLVDLDNFKQINDGFSHAIGDAVLQEIGHVLRSQSRACDLPARFGGDEFGVIFAADPETSVRIGARMCTAIRNHDWQRIAPGLRVTVSMGLAPLQPGMSSKELFAAADDRLYQAKRGGRDRLAS

SEQ ID NO: 15727 - protein, 715 aa, Actinoplanes utahensis
MVPTGGAVPTGVADPRRLAVLRATGLIGDRSFSGLDRLTAMASRMLEAPMSLVTLVDQDRQWFASAVGLPEPWATERQTPLTYSFCRYVVATEAPLVVMDARADVGLCDSKAITELGMVAYAGYPLRAPGGAVLGAFCVADSRPRRWEYRELTLVGDLAAIAASEVAALLGAGELAVAHQDAEQQRAFLEALLDSLDTGVVACDPAGRLIRFNQALRYALDDDADPALSPRQWARRLRVLHPDGRRFTAEEMPLLRALAGEHVRDVEHLVVGRDDQRLVFRTNAQRIAGPDGSVLGAVAVSQDISAQYRTGRFRDAELAVHRAFIASTDPADAAAAVVQAVGTALDWAHAELWLADELSDMLHPIATWTDPQRPAVHVPASLGRGSGLAGTAWHEQQPVWVPDLAAGAAPMTADIVTGSRLRAALAVPVRGADQALGALTVFAPTAETKDSTCVTLVAGIAAQVGAFLQRCRADELRRELIQSKDEYIALVGHELRTPLTSISANTELLRDTDDTTAFGEVRDLVEVIDRNNSHLLALVGELLDLAGLDSGHTQLHIAPVDLAALVGERVSAARPGAQAAGADIRARIPPRLTVAGDEARLRQMVGKLIDNAVKYSVHGGPVDVVLVDNDGVAELDVTDTGIGIPDDERELVFHRFHRSSRARTHGIAGTGLGLALCRTIIERHHGTIAVSPPADRSGSGTRISVRIPVAAGSAR

SEQ ID NO: 15728 - protein, 154 aa, Actinoplanes utahensis
MVVPVAAGSHDDAVLDVNRLGPVLPRVRISQDGLLLRPWFRRALLVPWARIKGVRITPADRWSGKNAVPGGHGYYMVQIKLAGDWRRVGQALRVRHSLLPLVVRERLFGERGSWSSQEVILFSGYETIRILWENAGGESGDEDDNWPRIKPAEG

SEQ ID NO: 15729 - protein, 155 aa, Actinoplanes utahensis
MATILIADDEPDIRDVLTLVLNRAGHRVLAVGDGLTALRVAERELPDLILADMSMPGLNGAELCHAIRRHRLLSTVPMAILSSTLHFDDPRLAGIDACSVLFEPMTNKDLVKAVEHLLADGPHRHSSEAGSLEERPPQYRVPRLGRSDPSHVRQT

SEQ ID NO: 15730 - protein, 176 aa, Actinoplanes utahensis
MTRSSAGLLRLVLRGISWRACVILTVGGNSCGMNGWITGRPPAVDEVIARWDVERPPQLQDLRRELQQLVRAGRIATPADADDVAERLVIVVTELTSNALRHGQPPTIVMLFRSDGQVIVDVVDHDENSVPAVDRHRAPARGGLGLQVVQRLAVAVGWYAADRVKHVWASLTLRTH

SEQ ID NO: 15731 - protein, 1505 aa, Actinoplanes utahensis
MTRSYTDPRLRLTDRICRMGLQDWMFGGSGKRLARALAAVEAGFDSPPLGRPVIRRYRRALRLALRANPREAVGLVRRYNARIPADRYHEAFRTGDACWLAAHVADGDQYAFAAVLELATTLGLPGLQHHARDRMSAVLGRSADVNEVIGQLRRWSQLQLLDRDTATRVLRAWLDRTPLERDDRVWQAFFGELPESQMPDLFEVRCFVGRGADAVRLADGSVSRLRAAVDVCARSSSVIDVDAGLAAARHQRWSVEVRNLLVRRGDLLVADRLFNEALLSYQEAGRTDRVSECHEWRGRYGIAFDTCPLHLTDRLIRLAARCQNDVHDLADRGDFVGAMNRVRAVLDRLDLAAHSADVLERAGATDVVARCQAAVAEQRDEILHAGRFHFGATTPVAHAAWSRFEEAAGDLVMAAQQAEAAQESLRAARLYRACGQFGRAERIHQNDTSVEALRDRAETRRAAGDALGAAQILQETADLDAAIDLYMQAREFGAAMACLHLLHTDGVIEDPRTVACLRGAGDYPELVALCLRSLAAGSRPAREELRLLRADPMVPAALQQDIDAALDDLEAGKREAFERLAPGWVAKAREEIDRRFAGIWGLDLGTSTCAVAVFDTATGRAVLCPTETGEHLFASTLSLDVHGDELVGLAGERLLTTRLVGHIAAAKRAMGTSRRFSIADREYRPEEVAARLIAHGRTVVERFLADRVADLVAASARAEFGVVPDELLARAAREHDMRLSRPRVLVTVPAYFTNNQTAATRAACSIADVEPVLLLREPTAACVVASLQHHLNGAVVVIDLGAGTLDASYVEVSDGVHRVRQVQGDTRFGSIDFDHAIVEELVARLGRQGIQAPASGPARQRLEVAAEHLKITLSSVSEAEYVLVGFADERNVTLTLSRTDLASVLTAPLGRLHRLCTRFRDELPRSPHHLVLVGGPMRSPLVRELVEKVFGLSATGIQDPRTAVACGAALQSAVIDGKLRQRLIHDVTSLSLGIQAADENGVVGYSRIIEGNCPIPVTRSAMYTTHRDRATGVRIQVFNGAVDSGSLIGTFCLEGLPPAPRGVPKIEVTFSIDESGVLKVTAREIQTGIVASIKIIDSTLLAPSEVDALSRRHHELAVQQELRHAGDRLRRELRTLVATVVARDVDAAWQRFCERKAAHRPSARADAGTQQILIEVFRDANQTSIDLDLVRVPLRDLLTNAQQYLDRPAAAEDPAGDLATGQHLLHAVQRHLARLDPLLARIARWNATLAQLTMADPDPLRRFRDLHDTREFVRALDSLRTHGVPLTDAADITRHLRCLAETGDAEAYRRVLVANAAGLGLVLPDPDRPERFLDPLRDTLVRVDVARHPDRTGCCGVLVRNDLVLVPGGLTEHTTPADVEIVGGAGPGPLVPAGLLTSTGGGPAAIRLKAAAPIGPIRLGHPKLLRVGDRVWAVGGPGSAPFTAVPGFVNRFGPTCGSGPRTLAIEIPGPVTDGPLFNDLGELVGLRSGTSAVQVESLESFPGPA

SEQ ID NO: 15732 - protein, 194 aa, Actinoplanes utahensis
MGSSRAHLGSVARGVVRWALGSGDPGRSYDPVRGCPIRPRSGHSCPEVSSVLIQDLSKGHRVELDILAMAGAAALVQAATTEAWGTVSRQVAGVLSRGNQSRRAVIEHQLVRTHEVLGSSPGEESAAAEEKTWAMRLADLLAERPESRPELQELVDTLRPPQSGVTIGDHAFVVMQNHGEAHQTNNFGPSSPSR

SEQ ID NO: 15733 - protein, 626 aa, Actinoplanes utahensis
MSWLSKRRYERRLLVTAITIVVLVAVVVLGYSVSYRQEAMAGQAQRAQRLAQSAQQVKFRAADFNGWQTAYALDIIRGEPEATADTSPSRAKFLDAAQKFDKDLGALELLSTSSPAAPTVDAVRRAFEQFMTVDRKVVELYRTGKPADRRAASELVLGQEIKLYGQIAGGCDATAALSVSAEETSLGRLDAVGAATRRYILILSIVAAALTVLGAILAEARQRAIEQRAKEAQRMASLGHLAGGITHDFNNVLAIILNYTDFVAENASPETLHDLGQIRKAAKRAAGLTAQLLGFIRHEAIQPQILDINAAIDEAQAMLARTLGEHIELVVMRSPEPVKICADAGQIQQILVNLAVNARDAMPDGGTLVIAAGAVDLEENQANVHPPVAAGRYLQLSVTDTGTGMPPETIARIFEPFFTTKPKGHGTGLGLATVLDIVTTAGGSIDVCSKFGLGTTFRLYFPSVDVPYGLASARRTDAAPPRGHGESILVVEDEPALAASVARILTHGGYQVRSAVSGPDALAAYACGGCDLLIADVVMPDMSGSRLAEILRRTDPRLPVLYISGYIDGNLGPNRLCKTDATVIEKPFTADHLLTAVGDALSRAPESSGMAGESPQPADNYPHTSA

SEQ ID NO: 15734 - protein, 160 aa, Actinoplanes utahensis
MKSITRVLAVGGLGLGAALVIGAGPAQAVDATAQPAVHGGSVQAVGHWDDSDVVGYFRTRFGCERVGRLGEYHGRWDDYDCSRVWSGFNRGAWVLEVATDDWNGDWDDDNWYHGWYDSWHGGDWDRGGWHRDHGGWDGHHRDGSAKVAVFPVNSGARSVS

SEQ ID NO: 15735 - protein, 212 aa, Actinoplanes utahensis
MLKVLATGATLLASLAGTGTAAHAAPSTIVPGEDMAITVAAANGSGCPERSAKVTVSPDNKAFTVTYSKFTAQTGPDAGPTDFRRNCQLALNVHVPQGYTFAIAGADYRGYAHLERGATGSESANYYFQGEPQSTRIRHDFSGPADTDWQRTDTVGIGSLSFLPCGEDRYLNVNTELRVNRGWSSRTATSFLTMDSTDGRIDTVYHVAWKKC

SEQ ID NO: 15736 - protein, 641 aa, Actinoplanes utahensis
MQPAGGLAQWMLKHRVQPVGPAAGEAHAEQHAWWKVMCLTGVDYFSSLAYVPGIAAVAAGATSPLATLLIVALTLFGMLPMYRRVAKESPHGAGSVHMLEELLPFWRGKLFVLVLLGFVATSWLITITLSAADASLHLLENPHSPAVLHGHGVAVTVVLLLILGGVFLLGFSEAVSVAIPLVAVFLGLNAVIIGAGLIDIVTNASAWSAWTSALTSGGGGFTALAGPALLAFPLLVLGLSGFETGVSMMPLIAADGADPEQRLTSRIGNSRKLLTAAALIMSVYLMASSFVTTVLIPASEFGDGGNAKGRALAWLAHERLGEAFGTVYDISTVLILWFAGASAMAGLVNIVPRYLPGYGMAPEWGRAVRPVVIVYTVISIAITIAFKADVDAQAGAYATGILAMMVSGAFAVTVSTIRHRKRPAAVGFALLTGVLTYALVANIIDKPDGIAISAMFIAGIITISLISRVARTTELRADRIEFDDTARRFITDTIDHDGQINLIANRRQAGNAAEYRAKEREQRGNNPVPGSADVIFLEIDVIDPSDFSETLAVHGVQVGPHRVLRAQAPAGPNAIAAILLALRDVTGVRPHCYFAWAEGSPLVHMIRYFLLGRGDTAPVVREIIRENEPDPARRPGIHVGA

SEQ ID NO: 15737 - protein, 480 aa, Actinoplanes utahensis
MSKDAGVAVDGHGFVVVANRLPVDEVTDTDGQRRWERSPGGLVSALQPVVRQQGGAWVGWTGSAGTETEPFDVDGMYLRPVSLSADDVDRYYEGQSNATIWPLFHDLVEQPTHRREWRQAYEAVNRRFAQAAADVAAPNATVWVHDYQLLLVPAMLRELRPDVRIGFFLHIPFPPVELFMQLPRRRELLRGLLGADLVGFQGALAAQNFLRLTRQLLGLDPEDDRVEVDGRTVVARAFPISIDVAEVDQLAADPAVQQRAQELRAELGGQRRLLLGVDRLDYTKGIEQRLEAYHDLLDDGEISNDDVVLVQVATPSRQRITQYQQLRERVEREVGRTNGEYGHIGRVPVHYLFQSYDRAELVALYLAADVMLVTPLRDGMNLVAKEYVAARRDEQGALVLSEFTGAAEELGDAFLTNAHDTDDVKRAILAALHADPEDLRTRMRRMREQVRAYDIDYWARDFLGTLAPSEAPQLATAPSV

SEQ ID NO: 15738 - protein, 243 aa, Actinoplanes utahensis
MTTDVSIDVNTDQQMGKNSMRENDNRQQSSGLNEIRTPESSAVGELSRTPKRRRRAVQMAGGVAVGAGLLVGLVGMPAAFASAGSKPPHVNPTSDPGDPVAPNCTSAKLKITMDPAEGATGHSMARVHFRNNGTTCWFRGYPSVVAYTASGAKVPVAQTPRGFAGGQAPGSDEISPLLLEKGDVVSAVVEALNAGKDGRACTPVTKLKVSPPHQSRSATVAWSGGCADFQVHPAFRGTTGQES

SEQ ID NO: 15739 - protein, 727 aa, Actinoplanes utahensis
MTTGAVFCVALAVLPADSAPSRLIYYIIGAATVTAILTAVRRYRPADARSWYVLTAGIGAFVAGDVLFEAMVAVTGKHLHLWYNDGLYLLGYPVLWAGLLLVARHRGPRDRAGVIDAAIIATAVGLVYWVFLVEPTLGDRSTPLVERLVSGAYPTCDVLMLAVVVRMLSRPGGRTPSVVLLATGSMIMFLGEVFWTFSLSTNAHIGTVVNAGFVFSYVCWAGAALHPTMPAVATGGLGPVRFGWGRLATITAATLLVPAVLFAQGLRQEPVDWIAIGVDSVVLFLLVLTRLSGFVQQVQRQSARLEKLALHDDLTGLINRRGFEQRLVTAVAAGSVQVCLLDLDGFKSINDRLGHVVGDRLLSLVAERLATALPDADAVARMGGDEFAVLVPGAGTTEGDAIVARLTGALREPVHVDGHELLVSGSIGIADAQDTTDPVEVLRRADLAMYAAKAAGVRARRYTPDLDRRAGEEARIGAELRVALDEGQFHLLYQPIVDLPDGELRYVEALIRWDHPERGTVSPAVFIPVAERNGLIVELGEWILRTSCRQFMLWRREQAAGAPEKISVNVSARQLAEPNFAGLVADILLQAGMPAHHLLVEVTETAVFEGGVAVTTLEELHDLGVHIALDDFGTGHSSLTLLHTVPVDVLKVDKSFVDHVTMAGRHAVIATALIQVANGLGLIAVAEGVETAEQAAELHRLGYRLAQGYHFGRPSVEPLRGAAAAAR

SEQ ID NO: 15740 - protein, 187 aa, Actinoplanes utahensis
MRRRTLLASAGAGAMLTVPGLPPAAAEAAAKPTLRTYAVQGTDLAVALLPGPAATILLYAARRFHYEIDALRSGDLVTDASGTVLDIRPGWYPAGARDGFLPYQLIVVHDIVAQCDGLLRWGGDERTPREGRFAIAVAPTDHRLRVLAKRLDTDAASPSRRVGAGTALPFTTDRVRRAQSLRRSMIR

SEQ ID NO: 15741 - protein, 835 aa, Actinoplanes utahensis
MNSCRRAGPAPRRRPAARSGEASPAYRSRPCRYHLRSCVRRCGLRRRQACAPAVSRRNGPLCSGLYRVVRPCSDDDESEVLMDAAVLAVQQWVNATYAGVSGYVVVTEDGSAGRQTMAALTRGLQHELGITALSDNFGPATLAALTAHGPIGPAETNRNLVKIVQGGLVCKGYAAFRLDGIYGTAVTAAVTALMTDAGLTARADGAVAPKVCKALLFTDSYVLESGASAPLRAAQQWLNGRYLNRSAFTVLACDGRRSREFLTALIFAVQYEGGLTDAQANGNFGPLTQAGVKKNGLIKAGSSGPWVRLFSAALTHYPATPVFTGDFDESLAAAARAVQQFCGLPVSGEGDFATWASLLISIGDQARPGTAADTVDEVTPARAQALAAAGYRTIGRYLTNVEGSGFDKKIKPGELATLAANNLRLFPIFQTYADSASYFGWGQGYADALTAHDVAVGHGIAAGAVVYFAVDYDATDTEVTQRVIPYFLGVDAGLRQRGGRYSHGVYGARNVCSRLAAEAFPRWSFVSGITSGWTGNVTYPLPANWAFDQISTMDVGTLEIDKCVQRAGADPGEGAFGSAATDLSAYLDWIDRLHELAVAFGTGDPGERVLEYLRAGRYDNWQTRKLAGGTNAAFVSYVDSTGLARVRTYRDPVAGVDVDVSRWGAAALADLRGRGDAGGWGGDLIAFYGGWRFTAPATAARDYCAAYLATSEKPAALDLAGLVADVDAYLAAAALRAGTTLGAHLRGADRGIRFSRFYRGRFGSDPNAAATAAQSLLTGTGDDVVTAYRTALLRGLSTTPVTVDDQLRQFCRGFADRLVALAEKEQIHIRRGKVS

SEQ ID NO: 15742 - protein, 346 aa, Actinoplanes utahensis
MIEKVRTAVLAVVAFGGAGLWAYGMAVLQPLCEPGSPWWDDKTDLSYGARDVRWGAALACCLALVVLARGARSAVAVAGVGVVVWAGVDLVLDRADVGGSALLPLLSVAGAVVAAAAVGCRRAGRAMVSPDRHVFGVVAAIAIPVGLAVSFVTSGRNAEPELVWAVLPVVALHAGVGLVVALETATPFTRARAMAVTVAAVIWVVALAIRAVTTENMLAWLWVEAAVSGLLLTGIWWLGRSQATPWERTGMTFAGGLMTPALFFGLLFATSVFDLLSPLTRWAGSVPGIDGDVSWTTAGLLTGLSLAFGALTTRSDGSRRTAPPASTATGPHHARAGTRATAPTRT

SEQ ID NO: 15743 - protein, 1729 aa, Actinoplanes utahensis
MSAAVDAGPQTHRPSVAGLEMLEELGRGTHASVYRVQRDGREYALKMVHADVLDRAGATAAFRREAALLACVDHPSVGRVYDVGETDGTPFLIMELVQGMSLAALRDQRPVSVVEAVAITAELAAALAAAHRVGIVHRDVTPRNIIVLPDGRPKLVDFGLAARQDHSVGHSAAGTFAYAAPEQTGMLARPVDGRADLYALGVVLFECLTGRAPFASTDVAELVRMHAVEPAPAVRDLNPEVPVALAAVVARLLAKDPDDRYADGDDVAAVLRGLVDNSAEERRVEGTGGRLVGRETELAELTRHWAGAGTGRAGAVRLAGVPGAGKTRLAGELARRARAAGHPVLTLLCAPGAPAMAPLRAALERYLDQVDRLPAAAAEEARQRLRTMAGDGAAVLQLLSPALRHILRAPQLADEDRQDQLVTATVAFLNRIGHAAKGLLVHVDDVQWADDATSRVLTALSASSAPVLIVSTERTGEAAWAPEVPIIEVPPMDEAEMAALMAHHLGNAAVPSSLVEQILARSEGNPFAALQYLNAMLDAGVLLPQWGSWRLDQYGLDRLDLPTDVLDLVVARTRALPETNRRLLVAAAAVGAPFTAALLAEVCDTGLPAALEAVQDGVARGILEPAGGGRHAFLHQRLREALLSDVDAAGRRVLHRLIAEHLDAADTGDSRDRYRIARHYTAAGPEADPLRTLAACRAAADAALTNHAAAQALEFLDLAEQAATDAGVPLDGLFHRQRGVASLRAGHLAAAERELAAALEHESDPLRRADLLAKIAHAQHSDFAATEALRTVRAGLRELGQPVPSSVLLQVITGLAYLLVGWSTGRRRHRYSGRDEAARQRDRVVSDLCDAGAMAAAVGMHMMLIPLFHFRALPAVHRLGPGPEYARVQAALAMIADAVRLSRLAERCYARADRAARAVGDPRLTTRVPWSRATGTDAVAGFGPATGSAIREMLREHGTWLPPGEYLSGVGALAGTLLLRGYTREAQAWYDRGRDRLAKDLVLPGNPIAAVGVQVAAMSGNRAEAQARLGGMLAAAGGRGDDQGRRMNIMMARACMAAEFPDTQDIDALTAEVRRWRITPRRVWPQQRNFWLYLAWAELARCRSAEPQERAARLRLARDAVAAFGRAADNDVLRAFHHAVLADYLELTGAAEKALTQLSHADRLGCGMDLPLLAHLVAVGRCRALRALDRRADADRQAELAVAIAVDHGWEHRARAGHALLERSGSHRTTVSRRQPADVTGELLRRRLHAVQELSAAAATVLDPGELARVALDETMRTFAAERAILFLAGDAGGPLTPYLGRGAGGTDLVEVTGYAASLVCQVHHTGSAVVLTGTDDGTAVRSQSVVANGLRSVMIAPLVSRGDVMGAVYLDTRLAQGAFSEDDADLLNVITQQISASLVTARAAQLEVNVRTAERQRAVADMMRAAVSDLAGTLVPDEALARLLTTFVRVTGADAGILIPLTGSAAAVAGAVDATLLPGFAALDAVRRGAADGLWAEIDAVTPGAQAWVAAPLAGRDGRIAVAVLTAREPGRFDDSHVSVVAALAEQGMVAYENAQLFTEVRRLATTDALTGIHNRRHFFEGASERCAQARRTGTPLSALMIDIDHFKRINDDSGHGAGDDVIQAVAGRLRDVLGGQGLLGRYGGEEFACALPGRSLADTAHLAEAMRAAVAGEPVVTRSGPIPVTVSIGLAELGEGTPNLDDVLGSADAALYEAKRGGRNRVAHHMG

SEQ ID NO: 15744 - protein, 502 aa, Actinoplanes utahensis
MTQIKRPRTGVTFLAECGWYLSTGTALVAGYFLLALVPGSGLLRLVAYATVVLSVPVAVTIGVRRHGCHRPLRWYLAAAGQGTYGIGDVIFYLHRFVVDVDTDLASSLCYLLSYPLMAAGLLGFIRRRAAGRDVASLIDTAIVGLGAGLVMWVYLLAPGLADATRSSAVKTTVLASAVMDLVLGILAIRLALGDIRVVPAYRLLLLWIGGLVTADLTYGYLQLTGGYRAGDVLDLLWLASALALGAAALHPSMRSLDRSPAAPEQPISTGRLAALALTCLTAPALLYLEYLQRAPLHVPLIAAASAGLFLLALARMKVIADGQRRAAITDPLTGLRTRRFLREAMHRHAGPDTWLLLLDLDHFKEINDRYGHTAGDDVLREVSQRLLAARRRGDVVARYGGEEFAILLPKTTVVEIAAMAEQIRQSVAGAPIATTGHSLRVTASIGGATWDDGHSLDELIAEADHALYAAKRAGRNRVMIAPNPAPRPPTTPAEALKDRPAA

SEQ ID NO: 15745 - protein, 420 aa, Actinoplanes utahensis
MTDPAGTVEQVWRQESSRLLGALLRITRDVGRAEDLAQEALAQALAQWPRTGVPDNPAAWLMTTAKRRAIDQFRAGERQVRAYAEVAVGVVEGYEQKFTVDHLEDDVLRLMFICCHPSLTADTRTVLTLRMVAGLTTREIARAYLTSEATVATRISRAKRTLAAAGAALEEPDAMERAGRLGSVMSAIYLLFNEGYAVTAGVEWTRPALCREAVRVAAVLASVLPREPEVHGLLALVELQSSRLAARQNAAGEVVLLNDQDRSAWDRAAIERGSTALEAARALGGDGPYFLQAAIAAEHARAASVPSTDWPSIAALYERLARVTGSAVVELNRAVALGMAYGPEIGLQLVDQVAEIPAMADYHLLPSVRGDLLEKLGRPDEAAAEFRRAASLARNDRERALLIRRADAASAGTGSPNRIG

SEQ ID NO: 15746 - protein, 117 aa, Actinoplanes utahensis
MLLVHETTRPSGQPPAELFAAIGALGAQESAAGTLIEVGGLMPIQAGAVVTLAGSVIATTDGPFVEATELVGGYSVYELPDVAEAARKAEAFLDAHRTTWPGWEGWVEVRAIMEMAG

SEQ ID NO: 15747 - protein, 139 aa, Actinoplanes utahensis
MTALIDPETATIASEMTSRGGSTRIAGWIVTGLVTLFLAFDSITHLVREKHVVDFNSRIGAPGWFPVVCGTVLAVCLVAFHVPRTRVLGAILLTGYLGGATAVNLVMGQPAFNTAFAIVTGVLVWAGLWPCDERARRLF

SEQ ID NO: 15748 - protein, 123 aa, Actinoplanes utahensis
MPSCPYVAGPAVISTSHLNFFPRAGESTPCPAPDLDHQLLLTAISLSTKVDDMVELPSPEDPDAALAAVVALRRLANQLERSAVEHALRQGWTWAHIGQALGISAQAAHKKLAPKIAQERDAT

SEQ ID NO: 15749 - protein, 166 aa, Actinoplanes utahensis
MKLPRPIQDMRTIKKLLTAAESEARRAGDELPGPEHLLLAAFDLPDDTARRAFERAGADPAGFRAAIDDTHQRAMHDVGVQVAGPDRPLPEAAPATGPYRLTAPGQEVFQAAVRLAKAGSGSPLRGAHVVAAIGGQQRGTVARALRTLGVERAALTAAADQVLTER

SEQ ID NO: 15750 - protein, 149 aa, Actinoplanes utahensis
MDDARRRPHRLVSGSGWQHPVPDAVPPSLISPDEARHTKVPPRCRAVSASRLCVQTRVLLLRDGVLSLSLMSEARAVEDLCEELRRRAGTASRVDLWVPEELTIGNAPEPKNPTGLGMALIVDTALSLGLMPDGFTQGAGGRTYHYKSE

SEQ ID NO: 15751 - protein, 160 aa, Actinoplanes utahensis
MDDSLLRRLRAEQARALLYDTEPHHAVMLACDLLAAGVDGDAVVALAAQSARTLSTHDANQHLAAVTAELGLAEPDLATAVELIAADTCERILDRSIAAGVGTHRLYVVGHERSPLSDLLPAVAALAERLEDELGGRADNDLQARLDALARTVLNRLLPA

SEQ ID NO: 15752 - protein, 444 aa, Actinoplanes utahensis
MERLAAAVRAGDIQRLTVLLRELSDIDLGGELGSALFREAAVAGRAEVVEELLLAGVDPNRAWPGRVEPVSWFAERGAWNMLVTVLMHNHGHSSWPTVPESSLRAALALARTWLTVDPEQELRRRLGALDDPATVVERERVPAWRDGDDGPSAVRIRVHTADGREDRVWVAHRAVVTLLEDALGIVTSNDEIAARAVHTAHPYSWDNAQAHTTIRERAERDAAVFDWLAARLTHPTVEHRRFAAEVVQGLCRRERPFDDAQAADIIAARIRDERDPVVLDNLIGAFAEFAFHARPGTDLRQILPHARHRDPLVRTRVAMELVLVTGSRRDETLPAPASSPPAAHIRTLIELAADPDPHTRATALGVLAGSYLDTTQVRTVFIDHLSDPHAPARVPAAAGLSLRDDVRGQDALHLLRTDPVTADVACGWLADLDRILARRPAPQH

SEQ ID NO: 15753 - protein, 231 aa, Actinoplanes utahensis
MARAHPCTYGGFVDTVDGQDEDKSFYRTVLKYSAGLCLGLLLLVTYPVYVRVTCHADFDAGRLETHDATVLSAHYYDVFDGSTHGTGQQITLRLDNGTERTTPEAANWIEVDKVREGARVTVGLSQGRLVSVAGTYVGPGYLYSGLGLWIMTGALVLSGIYAVQLRRAPAGRSKPHTAGYVTQALMLYLLFTIVVQYSRYEAWAPVIAPVLATAIPLVIFWTRHRRPAHAL

SEQ ID NO: 15754 - protein, 751 aa, Actinoplanes utahensis
MSWPLPDMPTLTDRRTRLTWTWMTAGTLICLGFPLLPAGGLLASVLYNGIGLAAFVAILAAVRRYRPARPYAWYVFAAGVIAFVAGDVAFEVGGLLHGEHPYPYWNDACYLVAYPLLWSGLLLAAGVPARRDLPGMTDAAVMATGVALVYWVFLIDPALGGHGTPLSERVLTVAYPGCDVIMCAVATRLLTRTGARTTSVALLAAGSVLNFAGDLAWSLAPTLTGRPASVITAVFLGSYVCWAGAALHPSMADAGAAARPATSVRFGWGRSTMLIGCALLVPAVLMIQGLRHDEIRWAAIGLGAVLVLLLVTARMTGFVRQIQTQSSLLERLAMRDDLTGLANRRRFGRRLGEALAAGSPQVCLLDLNRFKEINDRLGHAAGDALLLAVADRLRHGLGEVDLVARMGGDEFAVLLADATAEQADAEADRISVALREPFAVAGQKLLVVASVGVADGAGAGDAMEVLRRADVAMYAAKSGGGRWRRYAAGLDEHADEKARLGAELRAALDAGQFRLVYQPIVALPSGDLRYVEALVRWQHPDRGFVSPAAFVPVTEENGLIVELGEWIMRTACADFARWHAEQPATAPQRISVNVSARQLAEPGLAAMVASVLAETGMPAGCLIVEVTETAVFGGGVAVQAIEDLHTLGVGIALDDFGTGHSSLGLLQTVPVDVLKVDKSFVDNVTMAGRHAVIAEALIRVSDGLGLSAVAEGVETAEQAAELYRLGYRLAQGYHFGKPAAELPARRIAAAA

SEQ ID NO: 15755 - protein, 488 aa, Actinoplanes utahensis
MMKRPRAWMGFLIGGMLFVALYLWLPDNVYGVLGWDGVAVAGAVAIVVGIRRNRPAGAAAWWLLMAGQLANVVGDIIYFVASGSGGVFHPYDVPYLLGYALQVTGVLVLLRRRGAGRDWATLVDSMIITSAFALLSWVFLMKPAAAEASLGLAGRLMAISYPALDLLLVAMVAWLLTADGARNIAFFLVATNMVVFLVGDYFWAFANQTSYDPGTLGGRLIDCTYLTGYIAFGAAALHPGMVEIGRPAGPQRVRPMTLHRLMLLTAATLIAPALLAWQAYRGAGRVLDAYAIVTGSVVMFLLVIARMTMLVRQVQAQSAILAEHADLLREAAQLDPLTNLPNRRAWNAALPAALQHAARHRAPLTLAVLDLDHFKVFNDTHGHQTGDRLLTEATAAWSTNLRSTDVLARYGGEEFVALLPGTTAAEALDLLDRLRPVTPMGCTFSAGVATWDGVESGDELLGRADQALYRAKAAGRDRVVSDDVVAAA

SEQ ID NO: 15756 - protein, 301 aa, Actinoplanes utahensis
MPREPHPDAAPPAPMTRRRILATTAVVSAALLTGCPHPEKSTPRDTLAKLRRTRVARLAVAGEEPFGFVDAGGELTGAMPQIAREVLAAMGVPRIEPLVMDFTSLIDAVLSGNADIVAAGMSITTARCARVAFARPDFRLPQALAVRGGNPLHLADYAGIAARPGTRLGVLAGAVETEYATAAGVPEERIIPFTGSDQLTTAVIAGDIDAFALTSLSVRRLVATTAPGALDITPSFTPIVDGTPRLELGAMAFHPGAPDLLDAYTAAAAKLRSSGTIARILRAWGFENQEIADGTEPGCVS

SEQ ID NO: 15757 - protein, 779 aa, Actinoplanes utahensis
MARRLAALRRGQRALPWIGVTAALALMAGAWLWSGAVARHDETIATAAALATDVRAVENELARYADVLAAADAALSTGKGDDSALAAVSGGFDLPHRYPGALAILAIDRDAGGAAVVRTAQPQPARGYPIGTDLSTVPQAAATFGIATQARRPALSAPIPASGAMAGTVLAIRAAGADRYVGLHLDVQRFLDGLYGRAEISGNVRITDVSHTPTLLAVSVDDGRPSARTDEVAAYGRRWQIGYTPTGTVTVAGERTYRLVLQSAAALLCLVLLATVLGQARSRRRAVNLAERLSESEERRNRLIDTSPIPILEVDPQGTVEYENGAAARLLGHRPGAVLGSPLHLTVHRADGEPESLSVTEDLDGEPMTIETGAGPRWVIAYCTDTFRGRGRLLLLSDETPRHELQEQLAQVHRMEALGRLAARIAHDFNNLLTPIGGYLDLVLTGGNDLAAEDRDALTECRKATGRAAALVDQILAISRQQHDGTSTVTDVAAGVASMTGLLRRIIGPDRHLEVGLPPDDAGRPFAAIEPTALEQILVNLVTNARDATPAGGRITVTVDAGDTVRISVADTGAGMDDETLARVFDPFFSTKRDHGGTGLGLATVHAIVDGAGGHLAVESRPGQGTTFTIALHRHDAPPSDPAAEPAAATAPPAAENQTVLLVEDDPQVRQLAQRILQRHGYRVLACGTAEEAEKRYTEQRATISILLTDVMLPGMSGPELARTIAKVDPDLPTVFMSGYSDGELTDQGQVPAHTTLLAKPFPAADLTRTVAEALADAP

SEQ ID NO: 15758 - protein, 520 aa, Actinoplanes utahensis
MRRLAIVLSLLMMSVLVMSAPATARPAATTGFRWNDITAADGVVLKSNVIAPSAPGAHPAVVLVSSWGFNDLEYLAQARGLAEAGYVVLSYTARGFWLSGGTIDVAGPRDVADASSAVDWLLAHTAADPGRIGIVGVSYGGGISLLAAAHDPRIHAVASLSGWADLAASMAGGDTRRPQAAWFLQAAARLVGHPSPEMNQILDDYWADRNADARERWARGRSARYSIDAINRNHPAVLLAHSYGDSIFPAGQMLDFYTALSTPKRLELAPGDHATVELSGLAGIPNHVWTSVRRWLDEYLAGVDTGIGAEPGVVLRPHDSTAVESYRDVAAVSPHTDRLLLGAPHGLIPTGDLGTAVPSSTWDRQIQAGTDTVADGGVALLTNGLEGLTGILPTTSLPFVSRRDAGVWLSGAAPAGGWRVRGVPHLHVSLTSSRPAGTVIAYLYDVNALGVSRLFSHAPVTWHGSPTVLDLPLQVTAYNLPAGHRLALVVDTKDPLYFDANTAGSTITFHGGSWLDVPSA

SEQ ID NO: 15759 - protein, 174 aa, Actinoplanes utahensis
MPLTIRSAGEADAAACAAVYRPYVLDTAITFESDPPSDAEMARRIAAAVRSHAWLVAEDDGEIIGYAYAGPFAARPAYRWSCEVSVYLAVGRRRTGAGRALYRSLLPRLIDRGYRVAVAKTTLPNEASMGLHAALGFQLVGVHRNIGWKNGDWHDVAITQLDLVTDSEPPVEPC

SEQ ID NO: 15760 - protein, 116 aa, Actinoplanes utahensis
MSQDARLAGEMAASLERLRTLSDERQADLRRQQEATSPTTDAQKHRGRILDRRDDALDRRDDALDRRDGALDRRAKAVSRRDEALTRRERTLNDRQAEIEQRAEVLDKRERGDQRA

SEQ ID NO: 15761 - protein, 281 aa, Actinoplanes utahensis
MRILVTGGTGNVGRLVVEHLLQAGAEVRVLSRGGHAPGAAATVRGDLAQPDSLRAALQDIDRLYLFPYAGTAPAVVRLAEQAGVERVVTLSSGAVTTGYDTNFHLPVEQAVEASGMRWTHVRPAEFMLNNLWLWGPSIRAERTVREPFPDRAGCPVHERDIAEVAAAALVEDGHHGRAYTLYGPETLTRRDQVAAIGQALGEPVRLQAVTPAHARDMYLAQGGFAAASADFLTGFQSYSGGEPEAAPVPVEPHPMPTAADVTGRPARTFATWAVDHAADFR

SEQ ID NO: 15762 - protein, 415 aa, Actinoplanes utahensis
MTDLIGGAGQVLDPAAVRASVLARLAAEDLGGKRVCLVVPDATRSCPLPLLLDAVHEALHGRAAAVTVLIALGTHAPMTDEQLRQHLGGPYPGFEVRNHEWWRPAALVSLGLIGEERVAQLSEGRMRRAVEVTLNRAVAEHDVCLVIGPVFPHEVVGFSGGNKYFFPGVAGQEIIDFSHWLGALITSAEIIGTRGITPVRALIDEAAAMIPSRRLALCLVVQSGTGALHAAAFGTPEQAWAACADVSARTHVQYRDAPVRRVVSVIPGKYDDMWTGAKGFYKVEPIVADGGEVIIYAPHITRISAMHPEIEEIGYHCRDYFVRQWDRFSAQHWGVLAHSTHLHGAGTWDPVDGERPRVRVTLATGIPEQVVRGANLGYRDPATIDLEALAADPDTLVVPQAGEVLFRLNAAGTAR

SEQ ID NO: 15763 - protein, 276 aa, Actinoplanes utahensis
MSRRGADEVVTELAKMLTGVGRLAVAFSGGVDSALLLALAARALGPGRVLAVLGVSASLPAAERAAAHEVARHIGAPVVEVLTREGERPAYRANGPDRCYHCKDELFTRIDDEVLAAHRVDAVAYGENADDARRPDRPGSRAATEHRVLRPLADLGLSKADVRRLARECGLPVAAKPAAPCLASRIPHFVEVTPHRLAQVERAEAALRDLGFADLRVRHHDDVARIELLPEDLPRAVSSPIREAVHAAVLAAGFRFAAFDAAGIQSGAFTLPLVGR

SEQ ID NO: 15764 - protein, 95 aa, Actinoplanes utahensis
MEFSQVFWYVFMVLLFFGGSIGGVVQHLQSRRHRFKLEMAREHTNLVQAQAKLAEEQNRKTALEVRQAELEIERYDRRVPGSPPIPSLGVTGEER

SEQ ID NO: 15765 - protein, 260 aa, Actinoplanes utahensis
MSDTPIPADLDEALAGLLDMLAAPDPRVRDDQAYSTLVRWIRGGALDTRLTALGDMLAGRLVHPEIQARAFAPLVLAAIVDRDRETGVLDRAAVHRWRAAFGDWWLTEDDLRGWDERLGWLHAIAHGADLAGALGTSPRLDAAALAALLDLIGRRTVTPTAYRYAQMEEDRTARALVRILGRPELTEEGAVRWLIRVDELFDGGGPGPLPIPVANTLAVLRALYVMADRHALPHRTAITDATAVRLHAAFDAYPVDRSSP

SEQ ID NO: 15766 - protein, 89 aa, Actinoplanes utahensis
MIDDVRRTRPGPARPVLAGSAAAFVLLTPAVAGRLAPLLSFDAFVSHRAHTLALAHPAWRSAMAAVMISPTVFLIGYVVPAAVIGICTP

SEQ ID NO: 15767 - protein, 122 aa, Actinoplanes utahensis
MTKDRRRPGALEAAVMASLWAADAPMTPAQVQQRVGDDLAYNTVQTILIRLHEKDQVQRRRAGRGHVYWPVRDAAAAAVAQMRAALPDGTDRHAVLRQFAASLDAADAAILRDLFTDAERPA

SEQ ID NO: 15768 - protein, 251 aa, Actinoplanes utahensis
MTVAIYLPLLLALPLASIAPRVAGRGTPGPAARLLAATAAVAAVSSTWSLTMLALTMLDDVPPLSVRDDSPGLELPEPVPGPVALLAGVLLLGAGVRLLVDVRRRWTTHRRLRAVGEVQDGLVIADWAKPMAVAVPGAAGRPGHLLVTTGILRLLDADERRVLFAHEQAHLEHRHHRLVAVAAAAAALNPLLIPVRDAVAYLVERWADEEAAAHVGDRRLTAKAVARAALAGSGPEPGTALGIDGGAVVRR

SEQ ID NO: 15769 - protein, 290 aa, Actinoplanes utahensis
MSRGRSPCNLQHVGVDITRKLGQATLAAVTAALINPVPAVAATPKPDHVVIVVLENKRYDAIVGPAQTPWITALAGHAANLRDFYAETHPSQPNYLALFSGSTQGVTDDKCPYDLGARPNLARQLIDAGDSFAGYAEGLPRTGWRGCGSARYFRRHTPWANFSNVPSSVSRPYSAFPSHYRKLPTVSFVIPDVCDDMHDCSRATGDAWLREHLAKYVTWARTHNSWFVLTFDEDDRTDADHIPAIVIGVGVPAGQYTVRLDHYDLLHSLEKMYGLPYLGAAAARTGLPWV

SEQ ID NO: 15770 - protein, 244 aa, Actinoplanes utahensis
MNQATISARPALAVVLTALLLIATTAAAVGRLGVSRAVVTASLRAVAQLALVSVLITAVLRAWWSTAVFLLLMVLVAAATSARRISTLRRGWPAIVPIVAGAGLAGIVVVAAGTVPPTEIAVLPIAGILIGGAMTATSLSGRRARDELRDRRGEYEAALALGFLPRDAALEVCRPTAGQALVPALDQTRTVGLVTLPGAFVGVLLGGGSAVQAGATQLLVLVGLLAAEAVAAALTVELVANNLV

SEQ ID NO: 15771 - protein, 424 aa, Actinoplanes utahensis
MSYSSSGLATRTDRAWLTKVPAITATFWVIKILSTTVGETFSDYLAVNVGLGPLVTDAIMMTVLAIALVRQFRTAKYTPWIYWACVVLVSIVGTQITDFFTDTLGVSLYVSTAVFAVILAIVFITWHRQEHTLAITSIDTPRREAFYWGAILTTFALGTAAGDLSTEALSLGFRNGVLIFGALILITWAASRFGASLVATFWIAYVLTRPLGASLGDLLTQSKDFGGLDLGASATSLLFFGVILILVIREQLLANRHGVAEKGDGPLGGRRADYAWAGAAAVAIAVAGVGLSSLHTGSTDTTATTTTTDVGGTATGGGRPAQVKVIHPTTKLGNLTRFATITAAVKAKVDKNDLAGGKAKVKDLEVAWDEAEAGLKPRDPGKWSRLDGEIDDVLTALRAGNPSQADCTAALKTLITTLNQFDGV

SEQ ID NO: 15772 - protein, 604 aa, Actinoplanes utahensis
MIESFEASWQTVGDTGLRASAEPAFDRIAGLARVLLSVPVAVVALFDAQGQFFPGAAGLAEPWATLRQAPLSHTLYEPADLRQGPVVVADARTDPRCAHRPAISSLRAGSYVAMPLTDNAGTVLGALCVIGDRPRAWSATDLSQLSDLALTCSDSLQSRIALGRAESRSAAATATSRQARAVSARGELLLKASVLLAQARTVADTVDAVAQLTSPVFDPDLIGMVLLDDEHRLRVFGADGLPGDVASRWVSFPTSAPLPAATAFRTGQLLSLPDPAAITAEFPQLADEFFGLGWKAIACQPLPGVHGTLGVLTLSWTHPQHLDAEQRSIIVTVAGYLGQALQRIAHLDAQYTAARTLQRALLTRLPHTATLRLAARYLPAHHGDLVGGDWYDTVPLADDRLALVIGDVSGHNLTAAAAMSELRSMARALLIDRPDTPSGVLHRLDHANQALGADIIATAVIAYLDPQPDGSHRLQWSNAGHPAPTLITAGNRVTGLPGADPLLGARHRRPRSTHHHVLPPGATLLLHTDGLIETRDASLDEGISQLHRLLSHHRDPVTFADVLAAHANARIREDDVAFLLATAVPVAARHTLTAPAEGDCADGS

SEQ ID NO: 15773 - protein, 126 aa, Actinoplanes utahensis
MSHIVAADDDAGIRRVVERVLTRAGHTVDLCSNGQELVTEVRAQHPDAVVTDNEMPGMTGLQARAELLTTPDTEDIPVVMASGSVTPEQAAATLREGDRVVHKPFQPAELRDAVREVLIHRRPRPA

SEQ ID NO: 15774 - protein, 660 aa, Actinoplanes utahensis
MPELRGMQDQFFLMGNLVIMVAYAAIMVAIVGPVAHAGQLRTNRLATATALIFFSCAVGHGLHAAMAYRTVMQVPAAHRMQMDAAGWSWTSAVWDLLTAGVGVYYWTLRRNYGVLLGKGGLYVDPWGQRRLDEADARERAARDVAEAQRAALATVVEHTDDAVVGLTPEGIITAWNGGAERLFGYPAEEALGQPVAVLADATGGGEQVDVLDRIRQGERGMAYETRRLRRDGTAVDVALTITPIHDQAGTVIGASAIARDITAAKEAAEHRRAMEERSNQAQRMESLGKLAGGVAHDFNNILAIIANYTEFVAADTSDRPGVQADLTQVRRAVERATNLTRQLLTFTRAQAVQPEDVDLNMAVTEVQMMLERTIGEHIDLVAVPSTRPLMVHTDPGQLQQVLLNLAINARDAMPEGGTLVLEADAVTLDGEEVDMQPPLPAGTYARLLVSDTGEGMSPETAKRIFEPFYTTKPQGRGTGLGLATVYGIVTEAGGSINVYSELNLGTTFRIYLPLVTAESAAAAAAPVHSTAPPLGGGSTVLVVEDEPALARMVARILSEAEYRVLVAADAGEALDLYEQHGCDALLTDVIMPGISGRRLAESLHERQPDLPVLYMSGYSNGLLGTTHILDEDIAFLEKPFTAADLLHKLAAVRTTSSSQR

SEQ ID NO: 15775 - protein, 796 aa, Actinoplanes utahensis
MFPGTAQLRRGCADPGDMGGVNLPRPDPAPLEPLEERTGAGVARWLARTILTMARTGNFSDLMRVVVEGVAQAVPADAVAVVERGRVVAMVGSDEPDRVLRVASGGGTADDGVVVPVARVAPDATAWTGEMTLVLTGRGLGSDEIAVAEAVAAALGVCLSGRRRHDNDSPPAGAADAEGQAARLLERLSVVQRAIARQAPLDEIFRTVTAQTQALLGDDIVALALRDGDDPERLHLVAAYGFPDDVLHRLWSTPVAAGGVTGQAVLRGELVVFDRYADSAHALREGVEAGVHTAMAAPVIHDARVLGSLFVASRKPERSYGPADQNILTAFAGHIGVAIQSARAVDGLQHAFRDPLTGLASRALLLNRLAHSLAHAHRGGGRIAVLLIDLHRFRAVNDAVGHAMGDAILIGAAARLRDLVRGTDTVARCGGDEFAVLLHGAEHVAQASAFARRVMAAMARPFTDGSDGEVTVGCHVGIAFSGPGADSAETLLQGADLALIAAKQRSMGTYEIFQPAMQAALRVRTRIEADLRYAVERGELEVHFQPIVDLRDARIAGCEALVRWRHPQRGMVSPLDFISLAEQNGAITAIGRWVLRQACRQTAQWNRRRPHAPLYVAVNLSGRQLEQSSLADDVVQVLRETGLESNRLVLELTESVLVADAPATLAQLRRFKELGVRLAVDDFGTGYSSLAYLRRFPIDILKIDKSFVDDIATAPASAALAEGIVHLAHTMGLATVAEGVEDARQREVLLNSGCEFAQGYHFAKPLTATECGEHLFGEQPSGSERPQPGSRAAARR

SEQ ID NO: 15776 - protein, 1418 aa, Actinoplanes utahensis
MVTGEQATSGPRPAVPAWSVYAFAQATGSGIFFGLPDGLPRATLLVVLNAVTVLAVATTARRCAEGRRGWSLLATAQLLSTLGWVCWYLYPMAAAVTVPSPSLGDVFFIGSYALSAVGVGMLARRHADRRTVLDAAIVTTSLGVLLWVVFIAGHAVTPGLSLPQRLTAVAYPVLDLLLLAAALPLALNVRRSPRTLLLLGWVALQLCGDMVFNVQVLHGTFRFGGATFGWWLLSYAVLSAAARYQSSPATGAASRWVRPVLLTIAVLPLPVLLLMRALQASGQDVVVIAGGSLAVTMLVVLRLLTTGRQSPPSAAVRAHLRRAVTRLCAGFVVLALLPLAGLAYLSVREATDTVRTEVDRRLTTSADASVAYVEQKLAGLRALVASYAERRLLAAALADNATADPAALQHHLTGLESRDPAFVGAWVLDAAGRMLAFDPPTPSVIGLNFAHRDYFQGALRTRAPYVSEAFATATPGNPRVVAVSAPILHDGQLVGVITLGYRLAALAAFTDQLAGAQQVRLKLADRRGTLLAGPGSEQPTLTSATGDPQIRAALAGGSGTARHMSDGVETLSAYRTVASVGWAVKAEIPAAQAFAGATRFTGRVGAVTTLLAQVLLLGLVLAVRSERARHAAQAHAGRREAQVTDILQAAGDAFVSIDTAGNVTRWNTQAEIIFGWPADQAVGRPLTELIMPDDQRHAHLAGVQRVAEGGQPHLLGQRVEVQARRRDGELFPAELHVWASGDADDTTFSAFIRDITDRKLAEAEVAAARDEALAASRMKSEFVANMSHEIRTPMNGVIGLTSLLLDTDLDARQRDYLTTVQNSADALLNVINDILDFSKIEAGKLDIDPVDFDPRAVVEDVVSLLAATAQAKGLEIAAVITPAIPPALNGDAHRIRQILTNLVSNAVKFTAHGEVVVTVEIGEPRDGVREVTFAVTDTGIGIPADRQAHLFEAFTQADASTTRRYGGTGLGLTISRQLVGLMGGSIGLDSEPGRGSRFHFTLPLPGAGAPLPGSHPDPELTDVRVLVVDDNSTNRTVVTGLLTGWSMDAHAVADAGAALTALREAADAGTPYAVALLDMHMPGLDGIDLARIIHGDPLLQGTSLAMLTSTNQAGEAQAARDAGVLAYLTKPVRAIQLRTTLLQLLGRTPASPAPEQTSIAERPGSTAHVLIAEDNEVNQEVTREMLAALGYTCDIAADGEQAVRMLQTRHYDAVLMDCQMPVLDGYQATEVIRRLPAPRNAVPVIALTASVLASDQQRCRSAGMDDVLTKPLRKHDLQAYLTRFLPNPASPTTATTTIAEQPHDISDLLDPAAVEELREMGPGFIDRILPNYLRNAPAAAAQIAAAAARQDMTELARLAHKLRGSSGTLAGHRLAATCTDLENAATSGDVVAAATLAALVHQQTHATCDALHTTLTLH

SEQ ID NO: 15777 - protein, 253 aa, Actinoplanes utahensis
MAGRRPRGIYPGGPVGDDAGMSSAAVPPGTPQPAPVAPAELIGRLRPFVLARAVVPAGAAAVGEMLPGLVATLGVDMGGQVNFVPTATVEALGGLRAAWKAAVTNLTRLPAMSVGSLEATAGHPDSVIYELHSTDPFGASRVCHLDGLLATAKVAGSRHGLLVALPTWYTVLLHVLTGPGVLAALNVMGKAASAEHAAASGPKAVSPDVFFVNSAGKAETVVYSDSMDGLVVNTNGLIKESLFGPGGLLPQGR

SEQ ID NO: 15778 - protein, 630 aa, Actinoplanes utahensis
MSDSIGRLPREPGTETARVRRWWRDPVIVGLGLCGLAATCWFLLGGADDRTRVLVTWMSLPPLDLAILLLSRRVARGVDGAPRRFWRSMAIGGGLWAAGDLSQALVTLVGGPARTLDAVPTQAGAALVGALLIVVVTLTYPIGTRSRTVRLRFHLDAATVLSAATVVFSALLIGSGITAAGFSAFTTAMSGFIVLMVGVFVTLRLGLSGRSPVQGAAAAAIVAAATVQGVANMIVPFGVQGQMLTVQGLTLVLPCVLAALSARLQERRQAHGPRPAAAPARPRRRFSILPYAATILVFAVLIVSLLNGTTAQTWGAVAGLLVNFVLVVARQTVAFSENARLLDRLDDTVKQLGQQHNRLEALLRHSSDITSICDAEGRITYVTPVVAQVLGYQPEDLMGIRLTTLIHDDDQVQLSSRTDVLFGAPGAQISYHARFRHADGSYRWIEVVAVNQLHESGIGGVVSNARDVTEERAAREQLRHQATHDALTGLANRRLLAERMRELRPAEAAVLLIDLDGFKPINDTYGHAAGDAVLLHVADVLRRCAGPDALPARLGGDEFAILLPGAGIEAADRIADRLQELLAQPAQVDGRAIRARASVGCAAGPTTDPEALLHRADARMYERKRLTRVP

SEQ ID NO: 15779 - protein, 36 aa, Actinoplanes utahensis
MLPAPYDWVIVWSKASEVVVADADDPTTDLRVPRAV

SEQ ID NO: 15780 - protein, 84 aa, Actinoplanes utahensis
MAVLPASFTIADTVYGLVVSTGASSPVIVEVVPSNDATAPRVVSFTHATLVAVRRLLPELSAIAVPLVWFSLQRAAGVRSGSPL

SEQ ID NO: 15781 - protein, 52 aa, Actinoplanes utahensis
MVAVVADRVSAAGELTCEAPSDTFSELAFIDHREPDGTRVASIGCQLPSSAR

SEQ ID NO: 15782 - protein, 174 aa, Actinoplanes utahensis
MCRTVKRGFQRTGRWAWTPRRIAIAGGGAAAALAAAGVTWALLPGDPQEPRPREYRDATACLLTDQQGVAGKDAAPIWAAMQSASARTHGQVRYLAVTGEQSVANAESFVGTLVLGRCSVIVAEPGIPDQAVRAAAAQHSGQRFLVIGGVKAGSNVTVVAAAKIDEVVGGVLNR

SEQ ID NO: 15783 - protein, 248 aa, Actinoplanes utahensis
MAAGTVAMTVLAGAAPAHAIANGEEVPDGQYGFSVKLTMTGIPTADGGRRNSGCSGALVSARWIITAGHCFRDANGVRVEHPVADLTTAAVGRTDTTDTSRGHLLKVVAVRQSPTADVSLAMLEEPVRDVRPIRLAGKPPAVGTIVRLTGYGSLTSSNPVPVNRLRTGQLQVAQLSDTVTGFRGYAPQADTTPCPYDSGGPYFTESKGIPKLVAVVSNGPSCPHTAIENGARTDNITAWIRKVIHSGR

SEQ ID NO: 15784 - protein, 1192 aa, Actinoplanes utahensis
MQQPFKIASVLALLMAMLVVPTPARADQAAITDGLVLWYKLDETAGSVATDSSGHAHNGTVAGTASWTGGQGLTFDGSSTYVKVPNDIMSGLTAISVSFDVLVDADQPTPYFLYGFGNTDTSTGYGNGYLFTTGNNLRTAISTANWTKEQSTQAPAPQPLARGTWKHLAYTQTGTTGTLFEDGTPIATNTSVTIKPGDIGAGTTSANYLGRSNYTGDRLLKGRIKDFRVYDRALGDPELQSLAEPVVSAELAADRATLTLGDTSALTADLSLPATAPRGTRLTWATSDASVITAAGVVIRPPSGQAAGSATLTATLTRGSLTATRSFPVTVPPQLSAEDAVREAATALTVRNLGDVRGNLTLPATGAYGTTVTWSSDRPGVIDDTGVVHRPQAGQGATTVALTATVHSGAASATRTLTATVPELPAAQARTGYLFSYFTGEGTATGEQLHFAVSRANDPLSYREVNDGKPVLTSTLGTKGLRDPFIIRSPEGDKFYQIATDLKIYGNGDWDASQRTGSRSIMVWESTDLVHWTDQRLVKVSPDTAGNTWAPEAFYDKTLGEYVVFWASKLYDAADTAHAGNTYNRMMYATTRDFYTFSEPKVWKDPGYSVIDSTMIENDGEYYRFTKDERNNTSSTPCAKFLIEEKSASILSTNYDFVSECIGSGSISAGEGPLVFKSNTEQRWYLFIDEFGGQGYVPFTTTDLASGKWTKVASYSLPASPRHGTVLPVTQAEYDRLLTAYQPNLLVTAVDPIPLVTPAGVAPALPARVTARFADGSSSSVAVTWDAVPPAAYAQPGTFTVAGTVAESQNVKAGVVVTVPDVQAPVVSATVTPAVPASGWFTGPATVTVTATDAVDGAVVPKVRVTRSGDPAGQWTDQAPPLTLGADGSYLVEYTAIDAAGNSSGTGSVTVRIDTAPPVSQATVDAQSRTVTLRAADNDSGVSGLAYSVDGGRTWQPYTVPVRAGQTRLTVLYRATDVAGNVEVINQAVVPAVRVVLAPSTTRATLDATKVTYGSVPVVRVTVTGKLAERPSGTVRVLLGGTSVGSGTLAGGGATVRLAKTIAVGTRSLRVVYDGDARYAGSSANLTLKVVAAASKTALSAKSGTVHTGRKAQLTVTVTGAAGVTPSGTVLVIATNGTSTLVRTVRLDRAGRAVLALGPLGAKGTYRITAQYLGSASVTGSTSAATRITVIR

SEQ ID NO: 15785 - protein, 269 aa, Actinoplanes utahensis
MSRILRRVLLLAAAPVAALGFLAAPAAASPSPAPVLHFNADGSTAVDGVIESGHPVTVDFDPARLPRCRGTDEYGDSWGISVQYRIDGGDLRVYPVTQRVTADGKDTTVRSLGTLQLRPDTHQLQMWFVAEDRTGCHEEDTAGGANYRFDINQPPVLARAAYNADWSETVTGPLRRGGALVLNYDPARLPQCRATYRGYPAWEIDVYYRFDGGPVQSTPVNQAAEAIPVRIDIPANARKIETWFKNSDPYTQCSAYDSDYGRNYTFPIG

SEQ ID NO: 15786 - protein, 120 aa, Actinoplanes utahensis
MTEDPSSSRRERLGRVATTVALLSVPLMSLLCCVPGFAALGGMDSSCGTGFDHDCLNLSRPVFTVWPWVTGGIAAVALVTRLAIPRRAEGLRLVAGAFIVVPPLVNAVAAFAAVHRPGVI

SEQ ID NO: 15787 - protein, 451 aa, Actinoplanes utahensis
MTPAAQPGAEYSTDPYLPGHGNGGYRVLHYDLDLDYRVTSNRIAGKAVITARAVQPLSRFTLDLGHLRVQDVRVDGRPAKFAHRPDKLRIRPEQAVGHGAVFRIEIRYSGKPVPIAGRWGDIGWDELTDGALVASQPIGAPSWFPCNDRPDDKATFLVTLTTATPYTVLVTGDLVARRRGAGTTTWVYERTEPTATYLMSVQVGRYDVVDLADARVPQRAAIPPRLREALRHDFGRHGEIMEALERLFGPYPFREYVVVVADDDLDDPIEAQGMAVFGRNHLDGQRTHERLVVHELAHQWFGNSLTVADWRHIWLNEGFATYAEWLWSGASGGPSAASHAAQWHAWAAAQPADLAVADPGVARMFDPLVYKRGALAVHALRVRLGDTAFFALLRSWVAENQHRTVTTEQFRRHAARFSARSLDDLFTAWLDRPELPPLPRHPDGPVVRALS

SEQ ID NO: 15788 - protein, 1301 aa, Actinoplanes utahensis
MTVTSDLRLIELPEAAVPDEAPALFRSDSAPLRRTLLDILDATVTAHPRAAAIDTGAGVLTYRELADAVEALRVTLSGHGIGVGDRVGIRISSGTAELYLAILGVLAVGAAYVPVDADDPEERAELVFAEADVSAVLGDGLSVSTRRTPGGSAGRPGPGDDAWIIFTSGSTGTPKGVAVTHGSAAAFVDAEAQLFLADEGAEPMGPGDRVLAGLSVAFDASCEEMWLAWRHGACLVPAARSLVRSGVDLGPWLAEQRITVVSTVPTLAALWPVEALEDVRLLIFGGEACPPELAERLAVEGREVWNTYGPTEATVVACAARMTGDGPVRIGLPLAGWELAVVDPAGEPVTMGETGELVIGGVGLARYLDAGKDAEKFAALPSLGWERAYRSGDIVRAEPAGLLFLGRGDEQVKLGGRRIELGEVDAALQALPGVAGAAAAVKRTAAGNQLLVGYLVVREDGGFDLAAATQRVREQLPAALVPLLAVVDDLPTRTSGKVDRAALPWPLATAGDVDAELTEAEQWLADGWEQILGVRPADAAADFFSSGGSSLNAAQLVAWIRQTRPQASVADVYQNPRLSEMAVKLGAAGGQVAVRREVRPTPRRAGLAQFLLMLPMLALVGLRWVTVLAALGKVVAASWTPQVSWSWIVAGWLVLFSPAGRIAVAAAGARMLLRGVGPGNYPRGGSVHVRLWAAERLAELTGANGVTGAGWMITYARALGARIGRDVDLHSAPPVTGLLKVGRGAAIEPEADLSGYWVDGDVVRVGMVRVGAGARVGSRSTLMPGARVGKNARIAAGSTVLGAVPSGQRWAGSPAAPAAAKDAEGWPEQRPERSPLGSKFWVVAYSVTAQLLGLVPVLALLPAFALLGWGVSGRPALAGALLVIPVAAVAYLLTYAMIVLAAVRILSLGMREGFHRVQGRVAWQVWTTERLMGMARVALFPMYASLFTPVWLRLLGAKVGRNVEVSTVLALPAMTTVNDGAFLADDTMVATYELSHGWLRVAPARIGKQAFLGNSGMAAPGRSVPKRGLVGVLSSAPHKAKKGSSWLGAPPMPLRRTVEAADASRTFAPPLRLKLARAAIELCRIVPVMCAGALAVLVIAALALIWRAGGGWAAALAAGPVMFGAVIVAALTATAAKWLLVGRLRVTERALWTSFVWRNELADTFVEVLAAPWLFRFATGTPLLTAWMRTLGARIGRGVWLETYWLPEYDLVHLGAGATVNRGCVVQTHLFHDRIMAMDEVTLSAGATLGPNGIVLPGASIGARTTVGPGSLVTRGDAVPADSRWLGNPIGTWPAPASRRP

SEQ ID NO: 15789 - protein, 114 aa, Actinoplanes utahensis
MWELIEPVLPPWPAKAPGPRPAPDRMCLHGISFVLHTGIGWEDLPQELGFGSGMTCWRRLQRWTEAGVFDRVHQPLLAKSNAANRIDWSRAAMDGSHIDAKKGRRDRPVAGQPR

SEQ ID NO: 15790 - protein, 32 aa, Actinoplanes utahensis
MPGAAMATKGHKPKPAPPAVRDSDHHGIPDDR

SEQ ID NO: 15791 - protein, 338 aa, Actinoplanes utahensis
MRDDMKAVPVNSGAPPVAAVDQLWPTAVPIPYSSGRRVAGFRLRAVLVAAIAAVLGGLSGIALGSWLAWRTVDPLAPDKATAAGMAVTVLPGAFGHKVEYYERPTFWNPYSNHSLHGGTGVRVGTAQVDGIMPPNAGSEQIAAAVEDQMRAQGWHDVRTTVDRHWSDTPSKTEVSGTRAGYLAAVQIIPDQEPALSFILMWAEPPGQLRDTIAGGVAGMLLGALLGFSTSQRMRRYDRGRQTAYSILCLTTLVMLAPACLANIPTSTGSLTAATHRQGAGPSVYWGGFVLFGAEPLAILSLLPILAILTLCVWPRTATNRRHRPTEPWSQRAAEDIYG

SEQ ID NO: 15792 - protein, 672 aa, Actinoplanes utahensis
MIDYRLLFRRAPTPLLVLDPGLVIVEASDAYLAATLTRREDIVGRHIFAAFPDNPDDPEADGVQAINASLQRVLRDRAPDVMPIQNYDVPQPGGGFATRYWAPLHAPLVNAHGELQYIVQRPEDVTALMVSQTAGGELGRLTEELSRRIGQAEAEILARRQLQQQQQETMQVLADSLTTAVFGCDSVGRPVLCNDAARALAGGRLDDAPAEQWPQRLHLHDPAGRPLTEAGNPLVSALRGEHVRDAEVVMRTPDAPARTFLVHARPIEGRADVLAVVAMNDVTALRRAARLKECELRTSTVLASAEPADEVLADAVQVIGSMIGWAATELWIVDEIGQVLRRAACWAADGHGWSCTDGEPLPPDGGLPARAWRSNQPLWATELGDDRTPLRAALAIPVSSGADVLGVLVCSSDTPEVPDDTRTAILTGIGAQLGGFLERRRAAGLAAELDRIRNEYASLVGHEVRTPLTKIQAYTELLLDEPDLVEDHRDMVRVVHRNVGILTVIVDKLLDVAGLRSGHLEVHRRTMDLAAVVRQAVEAARERAHRDVTIEVDTPATTLIQGDRDRLRQVVDELLNNALIWAAEHSAIAVTLRADAHAAVLSVSNTGEPIPADERDRVFDLFFRGDAVRHSGIPGSGLGLTLARAVVEQHGGSIVVSDPAEPLTVFAVRLPA

SEQ ID NO: 15793 - protein, 278 aa, Actinoplanes utahensis
MDGTAVRTALWRALHVELDAPPHVLADTVGRALAAAGDDWRARPDMDPEFTRTFRAGMVARARFVEDLVVQQADRGVSQYVILGAGLDTLAQRRPELGGRLRIFEIDRPGPQEWKRRRLQEAGYGVPEWLRLVPVDFEVGADWLKPLVAAGFDVGRPAVVVSTGVSMYLTREATATTLRQVAGLAAGSVFAMTFLLPVDLVDEADRPGLRASTAGARASRTPFVSFYTPAEMLDIASRMGFGEVRHVSAADLAERYFAGRPDGLRPSSGEDFLVARSG

SEQ ID NO: 15794 - protein, 116 aa, Actinoplanes utahensis
MATEGIEAVFLETHNWGRAAKFFQSLGYELEFSTDHNSGQLRNGDGAYVFIAEVPQDREPTTRIVLRVPDGDALALDPVVEVVSPFSDTHYGTREMIVRDPDGRLWNLQAPASGKP

SEQ ID NO: 15795 - protein, 52 aa, Actinoplanes utahensis
MGETDVKQFNVYLPVELIKQVKLRAVESGSSLSALVADALRAYLDKPHEKEI

SEQ ID NO: 15796 - protein, 386 aa, Actinoplanes utahensis
MAAGLLASLSGTFVVAGVIPGAVAAGVLPIVWLPVIQSIETIEDMSSPVVARLLRDRDPGRVLVACEAFDVVACALALALIWTTPLRPAVVFVAYVLIVSVVPLFVDVAEELFTGEIARISHGAAVRFNITVYAMLGVSGSLMARPLGSLLAAAALPAALGVNLCCSLAGLLLRRRSVRTLAAIAVNPPEAAPESRSVRASLSDIVRAVGPGSPVVSGLLACSASIVAGYLAQWAAQAMPRPSAALTALLVASGVGATVGPYLARGVPLRVLLVARIAALGAVCGLALTGGLGGGLRFAGMLVLTVCFAAAVQGAAVLQATARQARYRGHLLAQMVGWSHSLAAAGTFVGVWCGLALGVQRAPVAGVLAAVAVTLAAMTRLSPRRR

SEQ ID NO: 15797 - protein, 253 aa, Actinoplanes utahensis
MEDGTRLVARRIGRGEPVVLVHGSAGGLDSWDPVHPLLSDRFAVWVYARRGYAPSDRAGGPKTYADDVADLRAVIAAAGGSAHVVGASYGATVGLHAAAGDAMGVRSLALFEPPLFAAGAGLAATLDLYRKLLRDGDPAAAAVLFAEQVSRVPAPILAALAGAAPPDPAEMVGCLHDLEAMVDDTLDVGRWGGTGVPVLLLQGSDTWAPMPETMEALAATLPDVTRVTLAGQSHFATHTAPRMVAGALLDFLG

SEQ ID NO: 15798 - protein, 187 aa, Actinoplanes utahensis
MRRRAAKERTSIGKVSVPAGGSYATCQMSCPIVTSRCHLSPQAPSRRNRSVRAGRKRSERTRRDSDMTPFDMSGTFQQKVNDGDLEGLLGLLSPEAVSRTVQGEVLTDPAKIRADLAGLLSARPHLVNTVRHIFSSGDVALMLIDWTLEVDTPDGRAQAAGTTTNVVRRGHDGEWRLAILNPIGTAA

SEQ ID NO: 15799 - protein, 279 aa, Actinoplanes utahensis
MTIGHDIWQVAYDPPAGTETLPIEVLSFAALRRMDRAHRRTRVQRPAFHILAIVESGEGRHRADFVDHPLRPGTIVWIRPGTVHRWTDVEAVDGPLILFTAGAVPEDPATAVCWQTTGADGDLARLAAAHLTAEHNARPASAAILKLLLSALLARVTRTAPPAPGEPGDVFHRFRAAVEAHFPTHHQVAWYARHLGYSPRTLTRATSEATGVGAKRFLDERITLEAKRLLAHTDLTVVRCAHRLGFADQANFTTFFQRQTGVAPTFWRLTESAGGAPAG

SEQ ID NO: 15800 - protein, 49 aa, Actinoplanes utahensis
MSHTDVHAALAARDADLAAFDILSLLGISDRDRELPDRLWRRFRAGDRS

SEQ ID NO: 15801 - protein, 423 aa, Actinoplanes utahensis
MTAVSNEQSATPGVDGDLRALFGQSIAVFASLGGPEHRVEAADPAFFAAIGMAPPRTGDPLVDLLPELADQGFIELLAEVYRSGERYTGRDVRVVLGRGAQEREAFFDFTYEPRRDAAGRVAGVHVIGVETTQVKQAQRLTAEHRALLEQIALQAPLAEVLDGMARTIERLTPQEVLVSVLLADADGRHLRHGAAPGLPAFYNEAIDGIATGEGVGSCGTAAHRREPVIVTDIGTDPFWADFRDLAGRAGLAACWSTPILARDGSLLGTFAMYHRTPRVPQETDLALNRIFAGTAALAIERHHIEQAKAEAEARARAAHDALAKVVRAERELRAEAEERAAAAADLAARMRSAAAAQGAAPHPENCQLGGASGCTEPAEIKIADSWGDSAWGCPVHVEEAIINVRSVFIASEELGGLATYVNR

SEQ ID NO: 15802 - protein, 141 aa, Actinoplanes utahensis
MLLRTDPFRDLDRVFEQLTGTSSRPAVMHADAERDGDTFYVYFDLPGVDPDSIDLTVERNVLQVQARRQRQSRDGVETVISERPMGVFSRQLFLGDTLDTEHLDATYDNGVLTLRIPISAKAKPRRITIGTGGSGPRQIEG

SEQ ID NO: 15803 - protein, 97 aa, Actinoplanes utahensis
MWSLPPTVDRWMLHVAASPHEVDEVLADLCLHQRSRAVTDPDFPACLIGPKNLGEPPAWMRFARTELDRLGYRTRWCDVGCVHHPLPQRIASLVTLG

SEQ ID NO: 15804 - protein, 421 aa, Actinoplanes utahensis
MAASFVSQTGNWLTFTGLAQLVQSHYGSAATAAAFAAQSLPSLLFVRAVVERIPARRRRAVYNLSQVVLAALSLSLAVGTPLTYTLIFFALSALLRGIANPLFMALVGEWVPAGERTAAFIAIGAAGSVTLALSPAVGGVVAVTLGLRWLVIIDAISFLLGLAILATGPAAAARGATAPAAAASSAAAASAADGAATAPVAAVPCATVPSATVAAAGGSAVAAPAQPALFTLRRLLARPTGLGGASAWTWLSLAGAAVNAVELPVFTLVHHFDSRMFGYALSCYGAGGFATLALRRLVTGRERLLPWLAGGYLLAIVAWVFGGTPGAFAGFFGAGLTYGLINGVLRGILERSAGVDPVPLWAWANQVVVVANLAVYGCAVVAFAAGLAPVAGALVLIAICAIFTLQAARVKESCAAPANPV

SEQ ID NO: 15805 - protein, 180 aa, Actinoplanes utahensis
MSGIDQLLLRPWRDDDAPAVLAAFATPDMATQAGEPITDPAAARRWITHWRNAGGAHPFAVAYAGRIVGHVAVSAVDRRHSVGWVSYWTTRADRGHGFGTAATAALAEWAFAELGLFRLELGHRVDNPGSCGVARGAGFLVEGRERAKLAYDGERYDVELHARLRTDPAPAPRYTYAVQR

SEQ ID NO: 15806 - protein, 232 aa, Actinoplanes utahensis
MCSDGGMGDSVEVAAIVDALPGQESVRRLVRQELADTGREHLLDDAGDDQGRSALIAALDECLRQNPDFGWALRSALAPEPVAEPVPRGYEPPAGPPRRWMPEDEVRRRWPTIRDTEVGRVAAAHGVDRWFRQTGPATGLYGTGAPGTLMFDTDGVERVATGLASGELRVRPEQRTDTGQGRDAHRRVMATAIVVGLVVLALCGLLGYLAVQSFRHPASGSGSSNCGDCGWH

SEQ ID NO: 15807 - protein, 210 aa, Actinoplanes utahensis
MMRFSWDGESADERSAIEQRLADRWVGDLDRLIERRLSDDTVDRRLARITGRRRWDWRRFLTMVIAWCTRSTAVPHRPHRPARSRGGSPLARKPGRIAPPRGGHPPKRRLRVVDRSGSGAVAALPAVPLEQVAFDLRRLDRMRRSDHIRRSDAVLAAVLRAYDARLELACRCLGIEEHLQTLQGVDRELERLRLEGALDDVGVPIRAMNP

SEQ ID NO: 15808 - protein, 182 aa, Actinoplanes utahensis
MTLWQRLTALRGLPAYGEILEFELFFRGRFPELVRFLMIKEDATLQDAEDAVEDAMSSAYRCWSKIDNPDAWVRQAAVHALIGIRRRDRRRRLALLAMRGQRTADSDLADSALHEEAEGVLAVLKKLPPAQREVLAYRLDGYPPGGDRAADRQGPADRPQQPAGRTPGGRRDPRIAGDRPRR

SEQ ID NO: 15809 - protein, 106 aa, Actinoplanes utahensis
MYAGPPRSRRHHTARSPVGGDLARRAPTLTLYGRQHTPAVRRSGRWQPVESRQRARDRTVSPAVALCSIAPSSVAGVYVFTQSVPVTVIAAVVTLGLAAVQAFPRR

SEQ ID NO: 15810 - protein, 435 aa, Actinoplanes utahensis
MAATARWPGVHQNRVVNRPAESLSPGQLLPLGRRFRIVLVLGFLTALGPLTIDMYLPSLPTITDDLHATAAAVQLTLTGTLVGLAFGQLLIGPLADAVGRRVPLLSGIAVHVLASICCVVAPNLAVLGSLRVLQGLGAAAATVVAMAMVRDLFDGLAAARLFSRLMLVVGVAPILAPTVGGLVLTWASWRGVFVVLTAIGLAIMAAAAVVLPETLPRQRRRNGGLLGTARDYGRLFTDRVYVGLILVAGLAMAALFAYVSGSSYVFQDEYGMSEQQFALIFAGGAVGLIGATQANVRLLRRWTPQRILSGSLLAGLGFAVVLLILAGTGAGGLAGILVPLWLVLVMVGLAMPNAPALALSRHGEAAGTAAALLGAVQFGVGALAAPLVGVLGVGAVAMAVVVFAGMLAATLVCLLVVRPHRLPVEDAEPAIAVVH

SEQ ID NO: 15811 - protein, 132 aa, Actinoplanes utahensis
MPSRRSRSCTERAGSGYGAGVSTTTWVRAAAAARVAWGVALVAAPHRIPRYGAAPAVAVLRVLGARQIVQGAVTLARPTPLVTGCGALVDALHAGTDLAAAAGSARWRPVALPDAVVALGFAAAGWWLRDAA

SEQ ID NO: 15812 - protein, 331 aa, Actinoplanes utahensis
MAPCPMSLCEAVTAMTDRKPSVRQRPIDPALCHLLRAIAVSHARVRRLVALRIVISAVLAGAGLVTVFAGASTGKPLSVTLSVVGVLWALAYSLGLASWADRELHRAALLQESFEVRFFQLPWNCMLAGEEIPAEDVRHLSSRYRGDPPRDTYEMPNLPRPFDVLVRQQQNLSWGSRVRHRYAQVVMFAMSGWAALGLFTAIARNSTITDLFVQWCVPSLGMFLLGWDTFREQRRVAEDRKRVCGNSRGRCLQLAPAGLDPVVNQDLCRMARQVQDQLYLSRSRAPRVPRWFFQRYYTQDSSDFTAGLAEARNSLLTAGLHNRPPRSPQRP

SEQ ID NO: 15813 - protein, 409 aa, Actinoplanes utahensis
MPVAEDQPDPGSSRVLRALLNGTFVPAMAPRLATALVTVVVAGFVILSLAGIAVRADGPGPIVAALACATPIIALQLGYFGRLPARPTGRAGHLALAVQAGFVCLPFLRFGVAWLSFAGLLAAGVLFTLAPKAAVPLFVLIVAGAGAVEVWCADATTDLPFAVSYAVVSTTLTGLIVYGLTRLARLLADLHAARQDLVRMATAEERLRLARDVHDLLGLSLSAITLKSELTYRLMDAHPDRARRELAEVLTLSRRALSEVRTIVDPGREISLADECRTAHRLLTAAGIRVRVVEQGRPPTGRVGTVLATVLREGVTNVLRHTGHGGEGRADGAGDRQGRSGQGGRRRGGPADLHTAGGLTTAGRPAGAARVSRRPSGSGRCRRAAARRRWRPGPCCAASSGPPPRDRRW

SEQ ID NO: 15814 - protein, 161 aa, Actinoplanes utahensis
MPASRILLDEPLTGARPRPGLQQALHMVQAGDTLVTPGLARLARSLSDAWSIIEHLAQRRACLSLAGHLHDPADGSLLRDLALFVQFEAELKGLQTREGMVLARREGRVAGREPKLSTEQRAELLRLHASGLHQVTQLARMFGVSRPTVYRLVQRAAELSA

SEQ ID NO: 15815 - protein, 594 aa, Actinoplanes utahensis
MTAPPGRRVDEPGRLTSVWRTGLDAAADPLFDWFADMVRSVVGVPVALVSLVGDDRQFFPGARGLGQPWQERRQTPLSHSFCQHVVATAEPLIVTDARSDARVRGNLAVDELGVIAYAGMPLTDEDGHVLGSLCAIDHQPRRWTAQELARLAELAAGCSRALRARIASDQAQVQQQAGMERERRAQAAVERSQLLLRASAALGAATTFDEVVDTVRTLVIGNLDPVYVGVSTLAPDGFVHLASGRQLPERFARQWKLYGADQKTPSGLAARTGRLVSFPDLAAIAEQTPDSLATFHALGWQSAASVPLPGEHGPAGALTIVWKQPHMLTDGEQVVLTALAGFVAQALHRAAAYEDQRTAATTMQQALLSTLPEVSHVRMAAQYVPAQQNDLVGGDWYDVIDIDEQRLALVIGDVAGHGITAAATMSQYRTMLRTLLVDHNDHASALLQRLERTTRALGLTATATAMVAYLTHDQAGGHTLTWSNAGHIPPTLVLPDGRISLLARGGPLLGGLRNITRRTHTRHLPPGCLLLLHTDGLIETRTRPIDDGIARLHQLLAVHGGAPLCELADILMNDTNPVDREDDASLLLIRTAPA

SEQ ID NO: 15816 - protein, 286 aa, Actinoplanes utahensis
MGTEASHPDDDESVPLTGQPRSSTCPSTRSSCTRRHSTDARHRYPSPSWSTVMTTTKRMARITGLAYLGLALSGMLGFLLIRDRLYIPDDAAATAASLITHERLARLGIVADLAMVLAQAATAVCFWKLFRPVQPVAAGSIAGFGLVNCVTILVAVMFSTTALDVALHNDATSAHQALLLYHLNTAAFSLSGLFFGLWLIPMGWLVIRSGYMPRPLGWLLIGGGLGYPISVITSSLAPAHSSVVSALTMPATAGELWMVGYLLIKGVSDAAPITAAPTAGPQAALP

SEQ ID NO: 15817 - protein, 235 aa, Actinoplanes utahensis
MKMAVCGIGTVVLAATVALAAAVPGEWVTSTGARHQWNYPLVMWPLLLALIVAGLVMTASWRWARPAAVAAVIVAAQVAGYGLVSVRSWFDLAATARVDGLDQENLPTVVTLAAVVMAAAAAAAVLAAAAAWQEPARGRSGLAPKRPGYLAVGAAVVTLPSLAATIMTVPDFVSAGWETSLTCLLPWGASIAAIAWLRGRSATTAGVTVVASAVLVVASTIAMHRTGHMYPPTSD

SEQ ID NO: 15818 - protein, 336 aa, Actinoplanes utahensis
MPDCRAMTLLDVLIEGLTAVGIDEKSSPGPSTPVALIAARGIVLRELEDRLPADGDGPFTVTRSLGPVRSYRAEVDLLRRRGGFSLADAACALLAVGALTDDDVAALLPHLPASCGIGRQRVLNRLADDDLGAARAAADRIRGDTGWKGHRDIAAVLADRGDAAEFLAGWKSYRAATDRHGMGELKRRLVEGVARTAGWAAALELVGDKRFGPALAVHAFTAFGADVDGLRRVLGRTGVLAELDQLAVLSSAVLRASGTDPVRNHPYLDELVDRIIAVDPSADRATMRTRDRLLFSLWPAMGETATLDRVRRAVRTPQYRRELTRLPRDLTASLRH

SEQ ID NO: 15819 - protein, 266 aa, Actinoplanes utahensis
MVDRHARGQAGRVVQRGRNEDHGVPSLLLSRVKLYRIEHYSEAVAVKRRYASDHRQEQARQTRAAILAAAARLFVDPGYAATPLTAVAAEAGVAVQTLYKTFRSKPALLSALVDVTVAGDDEPVALPDRPFVAEIRALPGARARLERYARHLTDVHARQAQVMLALAAAATADPDAATIWRKHLADRRAGMLMFATALAATGELRPGHTPETAADVLWLAMDVHNYDWLVRRRGWPVEDFRRWYVDTVAGALLDPLALNRRPDAPA

SEQ ID NO: 15820 - protein, 809 aa, Actinoplanes utahensis
MSLTLGEARARAAMLADVSYDLALDLTSPDDFGSRVTVRFRTTGGSTFLELHGAVAPTVTLDGAALLTAYDGNRIRLEDLSPGTHEVVVDARLRYVSDGAGLHAFTDPADGERYLGGYLGLDVTQRLFACFDQLDLKAPITVAVTADPAWTVLSNGLPVASAQGRWRFATTPPIPCDQFVVVAGPLHSVRWEHRGVPMGWHVRRSLAAQLDRDVAELRRITEACFDHFAEIFVEPFPFDSYDQVFVPELNWGAMENPGCVTVNEYLLPRQRVTDDDRRRQAMVIAHEMSHMWFANLVSPVWWEDAWLNESFADYMGFEVAENVAGHPGARVAFESAFKPGAYLADRRRSTHPVAPRAEQVPDAATGGTIFDQISYGKGNAVLRQLVTWLGRDAFLAGVNAHLSAHRFGNATLDDLLTALDAASPRDVRAWADGWLRRSGHDTIRVTRDGDVPVLTRDGVRPHRFTVTAYTSSLQPAGARLVDLADTPLALPDFAGLAVVPNAHGETFAKVDFDELSYAVITRGLTGLPDPLARAVLWAALLDGATPAAHLDLLARHLPHEPSATLISAALDHTRQLLRRRDQPGALDVIAAACTPAGDLDPQREVALTRGLAWSAADPGMLRRWLTTGSTDRGLALDPDLRWTVVTRLAELGVWDATQIERERRHDGTAAGELGALTALAARPDAAAKADAWAAMTQDPDISVRRFLALAAGLWTSPRRELVTPYVARYVAAAPALAGRGPAFATAVGRAFPAIPLTDAELGLIREALSGDVPTVLRRAWNDELDDRAAVTANDVPGTGSRGTSRRTVR

SEQ ID NO: 15821 - protein, 256 aa, Actinoplanes utahensis
MRARIAPRHLPGRHDPRTRLVGPVDATPYAGPMRILIAEDDPAMAAMLQRAFERAGYAVDAVATGTDAVWAITETDFDAAVLDVMIPEPDGIEVCRQIRARDRWVPVLMLTARDGTGDKVRGLDAGADDYLTKPFALDELMARVRALLRREPAQRPAVLRVGDLELDPAGRTVRRGENRIPLSAKEFALLHELMRRAGETLSRTHLIEHVWDFAYDGGSNVVDVYVRYLRDKVDRPFGRDSIRTIRGAGYLLDPEA

SEQ ID NO: 15822 - protein, 448 aa, Actinoplanes utahensis
MRFVPSSLRTRLALVFGIGTSLVLLIALSLLYVVLDRQLDGAVDADLAGRGDDLIAGIRSGDLTTVSGDPMAQLYAPDGTLIASGAALSGQVLLLPDQVRSARNHTVKSVALLDLRPDEPALRVRLMARPTGRDGDILAVAQPLATVESAGNRQLIVLAVATPVLIGALAVLGWLLVRAALRPVDLLTREAAAISTFDTDRRLPVITGDDEIGRLAATLGGMLSRLSVAFTRERAFVDDASHELRTPIAVLRGELDLALAAVDDPAEVRRSLLAAQNQVARLTRLAEDMLLLARERAGALAVHREPVDLTDLAHTEQRALATVSGLRIEVRGDPVIVDADPGRVRQILANLAANSGAAGATTAQVTIVAEEAGARIQWADDGPGFPHELLDRAFERFVRGDRSRTSATGAGLGLSIVRAVTIAHGGTAEVRNGPPLGGAVVTVHLPTK

SEQ ID NO: 15823 - protein, 288 aa, Actinoplanes utahensis
MMRGRDVVVIGASAGGVEALGELVRGLPAGLPVGVLIVVHTPADSARRLPDVLSRYGPLPAAYAVCGQRLTPGLLTVAPPGQHLVLTAGQVLRLHRGPLVHRTRPAIDTLLHSAARVCGGRTIAVILSGLLRDGADGAAAVAAAGGSVLVQDPLDARRPGMPTAALHRVPDAAVWPAAKLGRAITDLLDAARPTPTGAVLAPPAPPEHGDPSGIDAALWTAVSQLQAHAAAQQGFLRQLDRTGPLALVVRKRAARTLHAAQVITDHVIPVFEPEAGRCEAPGSAPTSP

SEQ ID NO: 15824 - protein, 317 aa, Actinoplanes utahensis
MKRVLSATGHEDIEQLLRAQYLTVRLRTRGDNKHFMVEQNTAGPVTLGHAAYGMSVDMAGEPIGALVIGHVRSGSATYVSRGRRRTWGPGDVFLGVEADEPFTATLDHLDSDFVIFDPATLSDVACTAPGVAGPVRLEGHGAVSPRAAARFMRTVAFLHHLTDDDPTGTPGPDASPLVALQAARLLASVTLDTFASNAMLEPTIEDRHDVHPATVRRAVAFIESHPDLDLSVVDIARAAFVTTRALQLAFRRHLGTTPLRYLRRVRLDRAHADLLAADPAVDTVTAIAARWGWARPSRFAADYRAAHGRHPHQTLRS

SEQ ID NO: 15825 - protein, 238 aa, Actinoplanes utahensis
MTIDHLCLTEYSPRDLVAFRAAPAADAVSGKELAFADSRRWQTGQELVVRFMDGDARTRARVEEIARAWLEHANLRFTFADRAGAELRVTFTGSGYWSFVGTEALAVPSAKPTIQLGGLSADDDPQELRAVVLHEFGHAIGCVHEQASPAADIPWDVPAVYKYYLGVHGWSAAKTEANVLHRYANDGTISFTDHDPESIMQYAVPRSLTLGGYEIGWNTDLSDGDKQFIAAMYPPADR

SEQ ID NO: 15826 - protein, 489 aa, Actinoplanes utahensis
MVSASWDGQRRQRLLELLLGGYETKRPLRHLAKQAGLKNGLFPDGGDLRSVCHDLIERLANAKILDDFVRCAANDVRLSGSREALLDLLFPEVPEQKPPDRVLTDNERARLTDLIDQWDKASRLPDESDVAVLVWTALGHIGRVELRACRSVPMMISLLDQRMHALGAMPAILLFLEHLLAHPDIAVSEERPILRRLIDDVAQRTRVAPENRGPTAAAGEILGQVMVYLELLDEDGHLRPEALVYRQTGKSYFVYQCVDAFPDWQEAAEQAITEIAPLLRRFDPGQIRFEIVVPWRLLGEPMDECLFAGAELGSQFEVTIRLGERRIFALYERRWERRSRLLHDRGDTPAEHLVRVVTPDARPGTVLRPGRPTDESVAVMIFSAVHHPPRTLPTRHVLLDAFREGVPVFLWFRGDQDPSQLHDLVKSMLSGAELNGIPAAVRARRHPSEPDDSDGAAAGQPISVIYDDFGTRPRRGGSLQPARARGGTQ

SEQ ID NO: 15827 - protein, 333 aa, Actinoplanes utahensis
MTTTPLWIYRGDGNPHAWDVPPSPPWREFAGQPMDRPPSPDAPGSRRRRHLASTYRAEPGEALMVNTAIHLRRPLLVTGTPGCGKSTLALSVAYELGLGELLYWPITSRTTVQDGLYRYDAVGRLHAAGLRERTRGRGGAGTQIGKYLSLGPLGTALLPADRPRVLLIDEFDKGDIDLANDLLTVFEEGRFTVPELQRLPNRTVTVQDDDGLPVEIERGAVECAQFPIVVITSNGEREFPPAFLRRCIPLRIAPPSPDKLRRIVQAHLGREVLADPLVRELVTDFAEILEKQDGTYATDQLLNLLSLRTGVSKTDDDWSALTRNLLGRLDDQP

SEQ ID NO: 15828 - protein, 915 aa, Actinoplanes utahensis
MSVHDELDVHHLLDVLWMARLVRADETGIAGPVGETADASAHTATDARPKGPGSPVEALSGVAAADALHQPVTAARLGSGSAAGGRATAEHAHRAGRAGQHGDATPVTSRALRPLRRRVPRRDRIALDEERTLRVSADLGRPVVITRPHTERWLDLALVIDASPTMGIWQEKVAGLRTAVRRSGVFRDVRVLRLVTDDVGDLALLTTGGQRHQPSELLDRTGRRLIALVTDGVDDRWHTIEAAAMLARWSAHNPVLTLQVLPPALWHRTALPPLPLRPRQVRPGIWQSTSPYPAEYETSNWIPVAAVDDSSIHRWASTVVSSRPPTLELPAIPVGFLPLADPAGPAMADDPVELVALFHSDSSPTAFALAGYLASAPITLPVARAIQEDLLPASDTGHLAEVLFSGLVERISPPRPEEDPDAVVYDFLPGVRHELLRTRRRDETFRVLRLLGRRSASVAGRLGTVDLFSLAENPSGYLRDHPDSRLAATVAVTVLGGFGGVYADNATRLQLMLEETAAPAPALTNPPALLLKPAPDATAGTQWAAPLELFGSGPVVATASQWAEVHRLALAGRKATIARDVGHRLATVWLRVSRLADVAALSRATLTLGPDANALYDLGRAESGMGRYRDALASYELALHLYRDAGARGDEAAALNNIAFLYNNLGDAAQALAYSERALSIQREVGNRAGEAAALNNIGSVLYTLGDRRQALDRFQQALVIRLEVGDRGGEATTRSNIGNVLLALGDRQQALAHHQQALPIQREIGDRAGEATTLHNLGSLYDDLGDRGQALTYYRQALSLCQEIGDRAGEAGTLSNLGNLYYALDDRQQALACHQRALAIRQELGDRDAEATSRFNLAVLLSQTEQIDDAAAHLRESIRLAEETGHPSLERIRSFLDELQPSGGKRPKGGGQSR

SEQ ID NO: 15829 - protein, 743 aa, Actinoplanes utahensis
MTSYQLEIFEQIPGSYELRLVAPDGAVKTRSVPRAVVDDLVETVDRYYTEHAIAPRVFGSTQLQDIGTRLAGFIDGDNGWLTPLLSPPGTTVRIVAGQRLRHLPWELLFDNGSFPAVDDRAALLTVRTRGTRQVHTDSPLPSNRPLRVLFMATSPEGVEPVLNYEAEEAAILAATARTGTALVVEESGTLEGLRFLFRDYGAGYFDVLHLSGHATVGADGEPVLLLENEFGGLHLATADQLVQAMAGHWPRLVFVSACLSASASTDDAPLSLGERLVDAGAPAVLGWALPVGDSAAIEFAAELYRNLADGQPIDAAVVAARRHLHRQKSPAWHLLRVYADDTPLDAMVTPLHTTGRAQLRIRHADQQFLDPRTMVSRVAARNRFVGRRRVIQRCLRTLRRPDSQALVLHGMGGLGKSSLASRLLERMPTHQHAVWYGRVDMSKFRELTDKVAFPTLTKHIEAMTLLSQDVVPLSVRLRYLLDANGPLGDLPCLFVFDDFEDGNLEQQDNGPVLSAAMAEILPALLGAIRDTGSTSRVIITSRYRFPAPTGSGLTVESLESLTDVEQVKKLANLPNLRPGSPLDQRIRVRAIQAAAGNPRLLDWLDLIVADATTEPDELLTAIEATADRFREEILAEKLLGSQPPELRRMLAKVNVVELPVPASTVTAMHDHPSADRHIERAVQLGLLEEGVDHDTRRPRYHVSNVLRPLIRPLLTDDEYVEACAAAAQSLYHLWVVEPTNREY

SEQ ID NO: 15830 - protein, 396 aa, Actinoplanes utahensis
MTTATLDRTAVRGDSAPGPKGRPRLYVLDAMRLVCALAVAGYHFGDSWWADGTHRPAYFLPHAAPVLIYGFLGVEVFFLISGFVILMSGWGRTVRAFAASRAARLYPALWAGVLITALVSTLLPIEGGLPLGPLPAGRDVLVNLTMLAEPLNRPLVDTVYWTLWCEFRFYLIVACMLAAGLTAKRVRLLGAGWLTAAMLMPAFPGAVLNQVVMADFAPYFVAGMTMFLLRRDRRDWWAWLLLAVCWLVSLHHVQLRVADLRPGFDVAAWPAPVLLTMAYGVLLVIALGGTDRITWRWLGTAGALTYPFYLVHQRVGYSLIRTARTATGLPVPTLIVGAVLVLLTTAWLIHRLTERPLAPYVRALLAGPRSLPGPGRVGHDTDPRDDTRRKSGLTTM

SEQ ID NO: 15831 - protein, 187 aa, Actinoplanes utahensis
MKSPPQLAVTVAITRRIDPSRDAEMAAWVRAGASLAETFPGFLGTGWVRPEPRSPEWHMLYRFADAGSLSDWEESPQRQWWLSSAEGFVEHTRVEKRTGIEGWFDPPRESPIDPPAPAAPARWKQATTIWLGFFPVSLLSGWLLAPHLITLNLVLRTLISTLVLTPIMTYLVLPRITRILQPWLRRG

SEQ ID NO: 15832 - protein, 286 aa, Actinoplanes utahensis
METTSAELLRRAHATADVDDLLDIGCDLADSGDAAGAEYCFRRASELGEPAGAFNLGNTLRDQGRLHEAVDAYELALSGGETDAWLNLGVVLDGLGDLAGAMRAYEQAERAGDSGGAVALAFSLREQGERAAAFVAMERAEAAGNTFAAAVLACWRWDQSLDPSLEPALRAAAELYPSARADLGALLVNTGRVEEGRLVLLRGMELGETESMVPLGNVYADVLGDDDAAEAAYRAGAELGDTHAHHNLANLLERRGDLVGAEWHFRQAAEGGDTLAAAALRDLLEG

SEQ ID NO: 15833 - protein, 420 aa, Actinoplanes utahensis
MLHGARSPGGRRLLYAVVTLAVAGAVAGVSSVADAAVVTGLHYVAIGSSFAAGPGISPVQSSTGAAACARSSNNYASVVARDLGADLTDVSCSGATTANVLTTSQNGLPPQIQAVTSATDVVTITVGGNDVDYLGSMGAYTCQNDGGSTCASVDRAAIDKAFADEPARLQNVVNAVHSAAPQAQVYLVNYFTILPDSGTCSGVPLTADQVAYERSIATRLAAATATAASAAGATLVDVAAASHGHDACAADPWVENGHPPTGRTQYHPNATGMRNAAQVIEAALAARGQVRAAEFRSGIAGKCVDVAGAGTADGTPVQLYTCNGTVAQRWTFTPGAGGSLRVLGKCLDISNGGTANSTRVQLWTCNGTGAQRWTLGAGSSLVNPQSGRCLDDPGGSTSDGNQLQIFDCNATVAQQWTPTT

SEQ ID NO: 15834 - protein, 135 aa, Actinoplanes utahensis
MFRIIAASAATTAAVALWAAPAQADAPLIETGVTAVCNAATGNWDLTWTLTNNLNSPALTITQISTPAPGVGTLPSVPGNGTAQAHQTVDGAASSAQLDYVAVWTQVWPSVSRYSSTTWTAPTANGDVTICTKTA

SEQ ID NO: 15835 - protein, 244 aa, Actinoplanes utahensis
MLEALGLVVDFLTRAIPAAAGRRRKKKLDDVGSELFLIYFRLNEVIVTAERILGVLENYVRRMSQNDGRSHLLEDLTGKSWQTGLLMRQRTNLQEVAELIFRDRSGLMLIDAPSYNALTPLLDRKMGLIRVLIRAMDGNRLPVAPSAEDIHCVVSLYALGGQHLDLDSEEMRRVQDRIFAEALSFDDVMDESTYRAVQRYLDAENPREQLKRIKGSVSNMRRSLLKHFTVEDMLLRAGDERFSN

SEQ ID NO: 15836 - protein, 280 aa, Actinoplanes utahensis
MPLCTAEPAAAWDRPYDIYQVVAPDKPGTYAHTEPRFASPTTTFLANGTQLDINCRGAGEAGTTRVLSGATSDNPDPHWIESTTARWVRLSDGTWVFDGHTDTDPGTPAISSCAATPLLSTPTCVEQDQGCATDDPEVSRCVTAGLVKLASAPIGDPDQGMAELWYSRGCRAGWIRARWTQPPSHFAGRTDRVVLTVGRQDDFPVSAAGRPAALLWGRMAVAQRGECISGHASYPLRLNGGTIGFSNMLSVTDACVRAEAQSADGQKRGELTTTRCADMP

SEQ ID NO: 15837 - protein, 209 aa, Actinoplanes utahensis
MSNTDPGTRGLPRRPAPGWVAPVFALLGAATIPWTIYLSVTLPQRMDTGYYRTAWVGFDVMLVLGLLTTAYTAWRGQQRVGLVAMATATLLVVDAWFDLTLSSRAEMLSAVLSAALVELPLAVVCGWIALHVDRLVARRLHRLARRAARLQAETVALKLDEPGRRGMSRLQYLLREQAHLRRDRGQAAAVKDFPPDSRSSRGRGADPRP

SEQ ID NO: 15838 - protein, 578 aa, Actinoplanes utahensis
MSASPWKSRPPLSRAAVARLVQVAGGFNVAAALLPAGHGRIMALAEFVPVAGILSARAATAAAGALLIYLGAGLRRGKRRAWQLAVVVACAGIALHILKGLDFDAAAVSAALLVLLIAVRGNFKTVPGPRSRWRALTALAGFAGAGFVLGLIEIAIRADHLVGTPGVQAWAQQSALGLIGVSGPVHFVRPWAAETVCLTTGTFGLLAVLAAVVLFLQPGERRPVRTGDDDARLRDLLARYGGNDSLGYFALRADKALIWAPSGKASVAYRVVRGVSLASGDPIGVAAAWPEAISAWLADCEVHGWTPAVLGCGRAGGTAYRKAGLDVIELGDEAIVEVDAFSLDGRPMRAVRQAVNRMSRAGYTCTAVRQRDLAPDDLDAVIRAAEWFRDGNVERGFSMALSRLGDPADGDCLLVLARDGDGRLRGVLQFVPWGADGLSLDLMRGDRTAPNGLTELMVVTAIEAGPGLGVRRVSLNFAVLRSVFARAEQLGAGPVLRMWHRLLRAVSRVWQIESLYRANAKYLPTWQPRYLCFPVARDLPRIAVAALTAEAFLPTFETTVATPAPRERITVGGGMLDR

SEQ ID NO: 15839 - protein, 329 aa, Actinoplanes utahensis
MSLTGVPLLCLVAFGAVAAMAGSVVVWRRGWRPRVPLRALSVLLTETLALLTVGLAVNRSEEFYPSWAALFPAAEQEPATVAARPGDLDAWLRAQGSADSGQEISVPWKPRGWTGWHLSAAPTVVVPAGYLQHPTNHYSAVVVTGTGWTVTPGVAEQTVVVFVPTTAATGPGVLTASLPALLSHDLRVTARRWALVAPAAGAALVEQAAGTAPDRYPAIALVRAKVAPVLKAFTRLLVAGHGVAAPVHPSTPPVPPGIRLTTVDGFPAGIAWAIRQTPPPLDTAIPAPTWVPSQPPVPRRSPGAAPKPKTPAGPPQVSPGPTTGVNSGS

SEQ ID NO: 15840 - protein, 367 aa, Actinoplanes utahensis
MAPDSLGAELVALAAAVLTAVLLSPLWNVAGGRWRLPVRGAALTACLLTATAAGLIWVNHEVDVYPTWGSLVSSDPAEAAAATGPHPASTKTGATTGQMLTTTVAGKASGLTMPVYVYLPPGYGQQPDVHYPVIEALHGYPGSPVQWVHRMNVGKILDREITAGRMSPTVVLFPYQTPSPTIDTECANLDGGPQAETFLTVDLPAEVRADYHVRADPAGWGLIGYSAGGYCATNLLLRHPDRYAAGASLSGDATPGIHIGKGAENTVYNDLWRLTHLPIPAVALYLACATTDRIPVRDMHDLARAAHAPLSVTTAYVGGGGGHNVGTWEAMEAPAFDWLSTSLGRPVVPPPSGEPQPSPVGSPAGGR

SEQ ID NO: 15841 - protein, 526 aa, Actinoplanes utahensis
MGRLPGRESGGGEIRMSMPLRPGDPVRLGRYELVGRLGEGGMGTVYLGRDSDGGRPVAIKMVRSEFAHDTEFRGRFRSEVNRARQVPSFSTAEVLDADPDHEPPYLVVEYVDGPSLAVEVRERGPLSGAALQGVAVGIATALTAIHGAEVIHRDLKPGNVLLARGGIKVIDFGIARAFEATSRHTRTDQMLGTVSYMAPERFDPADARPVTPAADIFAWGTVVAFAATGRSPFAADSAAGTAMRILTSEPDLTGVPESLRAAVEWTLAKDPQARPTARELLDLLLGGEAPRPVPEIAPVPVKARRGRTVAGVATVLAVLAAAGAGLTIRNRLQDGSAGTGASSAGSSSSPATAAASNRPAPKPSARSLSPLEKLQAIRNGRHKTLIHSVQLDRDLAMESHDTEIQAGDGTGHKSEFALIPAGVDVLIQSLAASTPGRPVCLGVRITAESAKLTPSECFTGPGTQFELIPAEKKEDQGRPAYYIYNDSSGYLLWDGKAFYVQEVGDGDPIYTFSFVDRGPLPSPSAT

SEQ ID NO: 15842 - protein, 227 aa, Actinoplanes utahensis
MTPRTDLVIPADLVAGLDIPSLAVTDATPDPVWAPVPIGQNTFRRDPSQRLPLDPRTAATTMRHRRLAPWGPPALFGTLIIYWISLHRHDLPLAVSLAGLAVYLGTIVGWQRVTAGLPAQRPRRLPSGDLRIPKVPAEVAAQWTVRNPGVTVTDEPMPRPHSRRFYAGWAIGLLSATVLLVVVLAEDGREDDIRLWMLVPMLFVSGIVMAFRMRPPARGKPEYTLLG

SEQ ID NO: 15843 - protein, 157 aa, Actinoplanes utahensis
MGISPYLARLRAMIGHELIQLPSVSVLVVDDRDRILLVRHAGDADGWAVPGGAVDIGESPAAAAVREIREETGIVIGPPRLLEVLGGDDFEVRYPNGDRVAYVTAVYRAEVAAGTPVPDREEISEVGWFAVRELDGVDLNRFARALLLATGHLRRRP

SEQ ID NO: 15844 - protein, 773 aa, Actinoplanes utahensis
MCRGSTDGATVGMVPARGRIWLRAGFAVGAVFLLAQFAAIVPAARDWMNRFTWLYELRQDAFYLVAVALVAARAMLVRRDRGAWSLMAAGLGCYAVGTVCWVAVFVWQDPPPFPSFSDAMWLAYYPFAYAAVLRLLWVQRSRISMSTLLDGLIAAACAAAFASVLFLTGFTGLTGPATSVMVSLAYPIADIALSGLLLGVWALSGWRTERVWLLLLAGMGTNTAANGLHAFDTTHGSFVPGSWEDALWAVALAGVALAAWQYPERPERRAPARATVGVVLPAVLACASMGLLLYGSWHEYVLPHASSAFAAIAIMAAVARMVLTVHAVASLADARRQARTDDLTELPNRRLFQETLDRDLHQRDPQRPMAVAIIDLDRFKEINDSFGHHLGDQLLLLVAARLGEAFGGDGMLARLGGDEFGLLLPAADMDRALQVATGLLTALRHPFELEQVTLHIDASIGLAVFPDHGTDRTTLLRHADTAMYTAKSDHSGLAIASGAADDDTGRRRLTTLEELRTGLDNGELVLHYQPQLDLVSGAVSGVEALVRWDHPTRGLVYPDGFLALAENAGLIGRLTTQVLEMALQQCRDWRAAGLDLTVAVNLSASNLHDPGLPGHVAAALARYGVPPAALHLEVTEEVLMRDAARATETLDQLRAMGIRLAVDDYGTGYSSLAYLHALPVDDLKLDRAFVGHCDTDPRSAAIVKSTVELAHNLGMRLVAEGVENEAVLERLRRWDCDLVQGYHLSRPQAPDRLTPWLLERQAVLLAVSQGGRG

SEQ ID NO: 15845 - protein, 414 aa, Actinoplanes utahensis
MGTLSRRLLGAAATATLAASTIIPSSAAATAAEPLREVMFVGNNWEGTADVIKPSGDFARIGRINVVPDKTQRLAEIYLNPIRLAFYLGIQQGPGEGHDQLVDDMYSTPDGTALVASRPSFADVVSIDLTTGKIRWRFPVSGFRADHMAVSPDGTKVAVSASTANTVHVLDINTGAQLGSFSTGDKPHENVFTNGGRYLWNMSIGNVDTSLDAPGWDWTKGDRHITVVDTGTWQIVKTIDMRSRLNAFGRSDLSNAIRPAVFSPDFAKLYFQVSFFNGFIEYDVATDKITRVKTLPKNPATSDDRTTFVNDSRHHGLSMSPDGSKLCVAGTMDDYATVVDRATLHEGTLVPAAKPYWATVSGDGRDCVISESGADAVTAIDFATGQKVVSVPVGDHPQRVRLAHIPASWTGVTG

SEQ ID NO: 15846 - protein, 655 aa, Actinoplanes utahensis
MQDSAAVLPTAGPDAARTADGHEAAALCPAPTILVTNGRATDNVKASRDTGQFPGGLMSIRRRATAAAGALITVAALAVGGPATAAAAAPGGITHEQNPRVPEGAVWTEVYFPSADHSGVELHADVLRPANLPAGARTPVIVAVGPYFSHTGQTGPEGWTQSGPSSRFADFTSGTDLFARGYSYVMVDLRGFGGSTGCLDWVGPGEQADVKAAIRWAAGQPWSTGRVGMYGKSYDAVTGLVGNDLRLPALKAVVAQEPVWNMYNYLFSNGVPRPNVTGTPAAYNGIATLAPLPDDSDHYRANAAYESSHPECLSDNLKNNDNPDPDSSYWRARNLAARAKGTGTPLFVTQGFIENNTKPEDIQEYLGNHHGVERGWLGQWEHVRGNQTDDQGQLLQGRAGFFDEVMRFYDRYLKGVLPAVHDPAFAIEDSTGVWRAQPAWPIPTSVTSAKLTDGQYVDDGLPSALAATGVPGARQWDMEHAADPAPATARGLAPLPAAGDTHSYLTWSTPVTTRLRITGTPRIALTASAPGNVQVRLWDVAPGGSAVMFDENVALIAKAGRVGVDLKATDWTLESGHQLGVQVGTIGSGTWLDTPSGNTIQVSRARLSLALQDPARDVPTQGDRSPFLDTYLRQYTRTLTGVGAGSFPLALRGRH

SEQ ID NO: 15847 - protein, 124 aa, Actinoplanes utahensis
MRNLMRGIVLSGLAATAGLAIGAGPALATAGTPVTCQKTATHHCTTHTTGMPGKTHAKGHHGHVTGMHGKTHHGHAASMHGKTHHGHAASMHGKTHHSTAVKPAAPVTKPVAPPAKPAGNAPKK

SEQ ID NO: 15848 - protein, 309 aa, Actinoplanes utahensis
MRVRNYAYAGVAAALSVALAVTGTAHADATPAAAVAVAPPVISADATMVHLQKLMSFAQASNNTRVIGSTGFTSTVTYIKQQLDALGWQTTVQNFTTGGRAAANVVAEWPYGDATHVVMAGAHSDSVSAGPGINDDGSGVAALLANAAAISQAKLKPQKRIRFGFWGAEEQGDVGSGYYVSHLAGGEAKKIDAYLNFDMVGNKPENGRAVGWSLYVEGQSNGLNAPFQTYFSAQGITVNPSLNTDDRSDHAAFKRAGVKVTGVSSVRSLNALGACYHRSCDNLTDVSQTSMGLAANAIASAVWSLAGTA

SEQ ID NO: 15849 - protein, 183 aa, Actinoplanes utahensis
MSGWRSGFMPAPEQLCRQRSRLLALRGQRLRAGAVTWDPAMDRWQPAGPVVLRFDRGDRLEIAWQGWDDLSITWNTVDLTTPPVITGRPHEWRSSVPPALAAVEGRILTGWAVTEDPYFPGGTDLTGELPMDAVAGWVMQGLLIRFGGSDLHVHAGADTTLVSAGCTESTTRVAHHGLVPDAA

SEQ ID NO: 15850 - protein, 121 aa, Actinoplanes utahensis
MSAGNADRPDGTCCPAYFLGGGRFAADIPRSPDRLTDEPGVHTGSAHTVVGMWFSVTRRVRHAAGHHPLAADTVFGLMLALPALAAVVRHGDRPLLPAAGAAVLGKVRPQVHSGAELPRSR

SEQ ID NO: 15851 - protein, 268 aa, Actinoplanes utahensis
MADYSSPMTDPLDVGRPHPARVYDFLLGGKDNFAADRAAAAEGLKVNPNVATAPLQNRAFVQRTVRFLAGEAGIRQFLDIGTGLPTSPNVHEVAQAIDPTARIVYVDNDPLVLTHARALLTSGPQGHTAYVDADFADTDRILSAARDHLDLGEPVALLLYAVLHFFDDEQDPYTTVAQLMDALPTGSHLVISHMTGDHDPEAWARFAEVMRRQGVHSRQRSLDELARFFAKLETVPPGVVPILRWRPDEQTTLTDAQVALYGGVGRKR

SEQ ID NO: 15852 - protein, 355 aa, Actinoplanes utahensis
MAVLRVRGFGLPDGEPIDLYADGDRWTTDPVRGAESVAEGWVLPGLVDAHTHPGAEEPGRPLDDDILRRDLRAHLDAGVTLIRAPGLAGDPPDWFGAADDSPRAQHAGPWIAQQGQFMDGWGRRPDHADLPAVAAAQAARTGWAKLVIDWKPADPVLPVGVLREAVARVHAVGGRLAVHTQQAAGGVVAVEAGVDSIEHGMGLDPDLLPLMAERGIALTPTLAAITGSLTQILADPERAARSWYVPGAGAHAGLTAAAVEAGVTVLAGTDTRPHGGIVREIRALVAAGVSPHRAIAAASWTARSFLGLPGLVDGAPADAVVFDGDPRADLGRLDKPLAVIVRGKRVPTRPWVPVP

SEQ ID NO: 15853 - protein, 357 aa, Actinoplanes utahensis
MTTTDSVRDQPPRTAPANRRGGWWKLPVLALAGCLAVHELQGHLPGVAATWTALRQTRAGWLTAAVLLQVISTVAFAEEERRLLGAFGVPIAARTSVAVTLVRSAMATSLPGGSAVAAAYGFRQFRARGASRPIAATVTALCGAASVTGLAVLYAGDALVQAGDPRVIAIMVAAVTGLALGVRTLRRHPPPAGEPATALARVRRGVHETLVASAAVRVPQWLAILALAVLNWLADLVCLIACLHALNLRVPIAVLGTAYLGAQLARQIPATPGGIGVIEAALILAVTTAGGAAAAPATAAVLLYRLLSCWLQLPLGAACWAVLRTPPSPAVEPPTPADLHGGAILHATGTARPGERR

SEQ ID NO: 15854 - protein, 212 aa, Actinoplanes utahensis
MTAALGPSFLAPEWLISTFGLVGILAIVFAESGLLIGFFLPGDSLLFTAGLLIAGGTYLHQPLWLMCLLVSVAAVAGDQFGYLFGRRFGPALFRRPDSRLFKQENLGRARDFFAKYGARSIILARFVPIVRTFTPIVAGASHMPYRTFLSYNVIGGTAWGCGVTILGYFLGQIAFVKSNIEFILVGIVALSVVPIGIELLRGRRRARAQRTR

SEQ ID NO: 15855 - protein, 740 aa, Actinoplanes utahensis
MGRDRGYFAARAARGDAGGRDQRAVRGCGERGGEFRAAAAAVAAADRAAAGGDDAAASRGPVADPSGAAARADGQHLVSGRGQPARAGGDVAGRRADAAAARVGRFRPGRGARAVHVGTTGCSGTAYTAGFSGRGVFAWRPRSPLGDDDHRAGAGEPRFRGGDRRSHLRRVHRVPGWPRPGTGGGSADAAAGLRPGRRVRHRSARGGRARRESGCGRPPAAGRAGPGDRRAADRHVRALQGWHRDRAADGRRPAGAGRADPGRADGVRSDAVDRSGSAGAADERLLQPGGPSGGGRVLVASARVAAHHPGGRGGASVVHRLSDPVRPGGPDRGVERRDAAGGDRHPGSGPGGADPAGVSAGLLRPASARAAQPAAGRAEPGVPRGQVPALGPGHAARHHLTRLGAAGSRPRLPGRGRDPHLAADHRGAGGAGRIHGLGGGPQPPASRRRLTDFRLAVMKVLSIQSVVAHGHVGNSAAVFPLQRIGVEVVPIPTVNFSNHTGYGAWRGPLLPPADVAEIILGVAERGVFPQIDAVLSGYQGGAGIADVIIDAVRRVKAANPNAVYACDPVMGNAKSGCFVAPEIPVLLRDRVVPVADIITPNQFELGFLTGTEPADIDSTLASADLARAMGPSTVLVTSVERPDREPGTIEMLVVADAGAWLVSTPHLPFKANGSGDVTAALFTAHYVATGEAATALERTVSSVFDLLKTTFESGERELQLIQAQEFYAAPRLQFRAQRVR

SEQ ID NO: 15856 - protein, 356 aa, Actinoplanes utahensis
MESSAVPVRVLLHLEVGEDRRLAGAPDADLRLIDLEAGPRPPHPHRVRVVEMRHPADFHVKVAEPVAEQSDGVRVQDEARPMTGQVESQRGTNPGRTRRGEQRTDVLRRHDRILTYACGEHQPCQDSPVPAAVLFDLDDTLIDETTASRDAVLAWAAELELTGPGADQRWARISARHYSRYQRRELSFAQQRRERVRDFLGTALTDTAADRLFATYLRHYEAAWTVFDDAVPTLRRARESGLRVAVLTNGEHSQQHHKLERLSLLSEIDLLVASSTLPAGKPDPGAFRHTVNHLGVEPVDVVMVGDSLEKDVFGARAAGLSAILLDRDGTRAGSGVPRVRSLNDLVFTPDRKMTPT

SEQ ID NO: 15857 - protein, 426 aa, Actinoplanes utahensis
MAVQRSNAMPARRLGTGSLIERIVAERAIYPVFQPIVDLGSHAVVGVEALARGPAGSALETPDALFAAAIEAGLLTELDQLCYARALETVRDAGPPVPPLVFVNAEPAGLSQPMSPDLAAVVRSSLPFRIVLEFTERALTSRPAAVLRLADLVHSLGNAVALDDVGADPASLAFLPLVEPDVVKLDMHLIRDPYSPKTQATAAAVVGYADRSGATVLAEGIETPDDEVNAAALGARWGQGWLFGRPGPLEMMLGREYAQSPAVSRFVPGVEPVHGETPFAIAAHRQPVRVAGPDMADALIDHVLASIGDRGRQSIVMCAINGPGQPSRWLPRLVAAADHFTYLGLLSGSALPSVADVQVQRIEESDPLREETVISVLTEDVSMALCLKSIGSESAGDRDSVQFVYPQSRHIVHPILRNMMRRFGTW

SEQ ID NO: 15858 - protein, 56 aa, Actinoplanes utahensis
MLIHPAISLTLADDHRRTLIAEADRERLATAARVRRGRRGSGTPPSPQATRLIPAR

SEQ ID NO: 15859 - protein, 329 aa, Actinoplanes utahensis
MMDPAQCLVMAVASLTYAEAVVIGLLQGVTELFPVSSLGHSVLIPALIGGRWAQDLSLGADQSPYLAFLVAVHVATAAALVWFFRADWVRIVRGLFTSVRDRRIENPDQRLAWLLIAATIPVGLAGLVLEHTVRTALGKPLPASIFLLVNGLLLAGVERIRRRTPEPRVPLAVGSDGVYVGSTAQQHGGVSAHGGDVESDHRLAGLGWKQAILIGAAQILALLPGISRSGVTIGAGLLRGLSHEDAARFAFLLATPVIAAAGVLKLPELAGPAGHGIAGPVLAGSLVAGVAAYVSLRFLTRYFETRTLNPFAIYCVVAGLGGLIWFGVQ

SEQ ID NO: 15860 - protein, 179 aa, Actinoplanes utahensis
MFSRATAPYAFGLLVGFCVVPFVLPIFLALWILGAGQPETDEEMSADPLLVWRRDRHYARVVSVVVGAYVAALGGLVLYDHYFTGSSMTAPAGAALLGTSLAFGGLAGGAACLISGATWPTRLTFLQLHRSVGTPVALLAFLEDAGSRGILRAVGRGYEFRHALLRDYLLAHEPHPPGP

SEQ ID NO: 15861 - protein, 353 aa, Actinoplanes utahensis
MVRGSPGLTDLGDERAARRPAARLCDQRRDRGADRRPARSRQPLRRADQARSQRVDRVAARPGAPAAGPAHRAGPRGDRAGAARDGPGRRLRPAPARHPAGMIGARGLVRCYPRPMRDRWGSGLEDEVRAGGWRTVPNLLAGAAAMWLHPVLWPAGSPLQRRSRATVTVFLLAGVAWLLGHLLAEEDSLLPRSLAHARPLLLSDLLISAALLLAAPFPRRTAAALRQLLAYVVRRLAVPTLAGLAIVCVANTAGLAVPPAVRHLALGVWWATLLAGVVQTCRLIADLGEATTTAPRLSYGLWTLTAALAAGSATVLAAAPHSARPLTTAVLGVTMLLLTVPALLTLRDLCDVA

SEQ ID NO: 15862 - protein, 291 aa, Actinoplanes utahensis
MTDIPFRAENVTKRFRRTTAVDAVTWAPRAGRVTALVGLNGAGKSTLLRMLAGLIRPTSGTVTRHRPLSAMIEAPALHAGLSARRNLEMHRILTGAGRARLAEVAELAQVTEVLDRRAGALSQGYRQRLAIAVALLGAPAALLLDEPANALDPEAVVHLRHLVRTVAAQGTAVVVSSHQLRELDGVADALTLLHRGRIRYDGPFGDFVGPARLRVRASDRDRLTRALHDDGLTAQPGGDHLWITPGRPGPDRTASRVFAAAARAGVTLVELSHVAPTLEEAFHQTIAEVRR

SEQ ID NO: 15863 - protein, 231 aa, Actinoplanes utahensis
MISSYRAETLRALSRSSAAFLALCTALTWFSMVNAGPQHQTPLWGFRQVAIFTATLVLGRAAVVAAGDFGSGTIRPWLISARTRPGTFLGKLAASATFGLVTALVTGLAGEAVSGLLGPVPAPAAMALAVAQLGFACVALAVFGHAAGMLTRSVPVALTVAIGWILPAEAVLQGHSATVDRWLPGNVLQDFTLGGVAAGSTWAGAAVHATLPFLALDAIALALFLRRDVND

SEQ ID NO: 15864 - protein, 299 aa, Actinoplanes utahensis
MRRAPIVAALGAAAGSETLSVLSTQIRDVRASSPWQSDPYNTVLSVTVFAVPVLAVLIAGRLAAWQAAGGGRRGREHHRAPGDDDRERQLRRAAAALLGLAGATAVIEWIAVALRPHPWRGWTGPLIGGLTVATLALALATGLLLRRRLPRRAPGIWASDWLSDLAGPPIPRPLTGWIRRHATAVFAGLSVLAAAGVVGSLAVGEAWTDPLLIGWAFVLEASAWFALAVLGNRICVFVLRPPHRTDAAAIGFSLGMLVATAFHGPISTVPALVAVTAGAGLVGAVLASVHRPRIARVPG

SEQ ID NO: 15865 - protein, 157 aa, Actinoplanes utahensis
MATGRPGAPVSRVGITVAAGGWHVPPIGILNRYSLVVTNDRRRPGALEAAVMATLWAADAPMTAAQVQLLVGDDLAYNTVQTILIRLHGKGRLRRRRAGRGHEYWPVEDAATAAAGRMRAALPPGSGRHAVLRQFAATLDPADAALLRALLADSDGD

SEQ ID NO: 15866 - protein, 133 aa, Actinoplanes utahensis
MITLPEGLLALLRRPSPCFIATVDPDGSPQLTETWVDTDGEHILINTVEGFRKVRNIERDPRVSVIVTDPDDVTDYYSVKGHVIDVTTKNGAEHIDELAHRYLGRPYPWFGGRDQVRLILTIAADRIVHAPRG

SEQ ID NO: 15867 - protein, 171 aa, Actinoplanes utahensis
MTEVMGAAPEPTGLSSLAARLDHLFDTIRPTAAELGEHDQPGRRYTNREIADRVNAVAGTMPGAVTISAAYIGELRRGVATDPRTSHVQALARAFGVDPGYFVDDEAARRVQEQIGLLNELRRMDVRQVALRRVLQDSGLSTASALLVEQMVARLHEVESDATDRSRHHRD

SEQ ID NO: 15868 - protein, 184 aa, Actinoplanes utahensis
MSSSQDDDRELRRRCQAVVDALEIPYPFDMALLCQRIGGHRGRPIHLIAMPMPPGGPSGVWISARDYDAIFYEADTGRPHQDHIIGHELGHLLCGHERGVGDDLARMLLPDLDPALVRRVLQRTGYSAIDEREAEMVASLLLRAAQRLGTPPPAVAPDAAPGGAAEVVARLQRSLGRPVGDLDG

SEQ ID NO: 15869 - protein, 387 aa, Actinoplanes utahensis
MTAQSLKAVLFPLSAAICLLALTYKAVDARRRPRDPALIALLIAFTGKGVSFTLSTPAVSATVDAATGVPNLGALGIHLCGGVLSSAAFLAALVHWVYPRERVARAVRARVVVAAVIGIVMVALWWSASRGGRRSAHFLLDNAGEPAVIAYLLLYVTAFGTAMTEIVRLCRRYGPPSGSSWLRRGLALTALGASACIVYCLNRAFVIVAVQLGWHPLNWEILTPIANTVGIAGIAGGLTMPSWGPRLAAAVRWCRHYRDQWQLYPLWRDVCAAVPAVALLPPTSPLRDRLHPVDVEFRLYRRVVEIRDGLLALRADPGLGTGDREALRILDTSLNDSENYADELAWLRRRAAEYRRRTGPSPDRADTDCRTDPPATAGGAPKTTTWR

SEQ ID NO: 15870 - protein, 329 aa, Actinoplanes utahensis
MKYRTVGAAGPTVSAIGLGCMGMSISYGPPDEAESIRTLDRAAELGVTLYDTADVYGLGVNEELLGRWLARRRPEVLVSTKFGLRRGADGRVSEVDTSPAYVPVACDASLRRLGRQHIDLYYAHRRSPEVPIEDTVGAMAGLVAAGKVRYLGLSEVNPTTLRRAHAVHPIAAVQLEYSLFTRDVVAGEMAATCRELGIAVVAYCPLGRGMLTGRITSRDQLSEADARLRWPRFDADNLVRNLTLVTAVAEVAQEIGCTPAQAALAWLLGQGENVIPIPGTKRVRYLEENVAAVTVDLTPTQLDRLRSAVPADAVAGTRYPAQALARLGH

SEQ ID NO: 15871 - protein, 469 aa, Actinoplanes utahensis
MLSSLRRRRGPSSLRRRLMPSWLRRRLGVRMRSALAAGIVVAFASVLAGGILLVVARGILLDNVDSAASDRTAEVTAALTPRDAAALQVTLHSSRAGRGLVQVLTAGGTVVDASAAIAELPPMSELRPPAGQHARETTYLPIGEGEPWLIEATGVATADGQHTVLVAESLDVVSDSTAAIVTALLLGLPMLAVVVGVATFHFVGRTLQPVEAMRRQAATITATNLHARLPLPAADDEIAALATTMNTMLDRIEASAAAQRRFVADASHELRSPLTTIRANADLLAADASTAPHVQRIRAESARMSRLVDDLLLLARVDDQRSPRRQDVDLDDLIFAERDRVAVEHPHLRIEGAVSPVRVTGDPDQLTRVVRNLVDNTVRHARERVTISLTATGGQGEIVVGNDGPPIPPADRERIFHRFVRLDDSRSRGGGGSGLGLAIARDIITTHQGTLTVDDLPEGAAMRIRLPTA

SEQ ID NO: 15872 - protein, 227 aa, Actinoplanes utahensis
MRVLVVEDEVTMAETIRDGITREGFTVDLVHDGTEGLWTATEQPYGAYDVIVLDIMLPGLSGYEVCRRLRAAGVWTPILMLTAKDGEYDHADALDLGADDYLVKPFSFVVLIAHLRALVRRGAPERPAVLRAGDLTLDPAERRVLRGDTPIPVTPREFALLEFLMRHRGQAMTKTAIIENVWDAHFDGDPNIVEVYIGYLRKKIDHPFGRAAIETVRGAGYRLADEG

SEQ ID NO: 15873 - protein, 139 aa, Actinoplanes utahensis
MWRPPAADEEIARWAVNHPPQLRDLRGDLRRLVTAGRLPTVADADDLADRLVIVATELAGNALRHGRPPTAVVLFRSDGRLIIEVSDHDADAVPAVDPQRPPAAGGMGLRMVERLAERVGWYPSAPGKHVWAAVRLSGA

SEQ ID NO: 15874 - protein, 1309 aa, Actinoplanes utahensis
MSSQVSPVLRPATSSRASPTPLSRRTRSRPVCRVRAMTAWAAITHSAPLPKAGFAPAIQRTSRKTASMPTAAATETSLSRRVSTTRVRARLAYSRKPDLGANRNSFTWLVTGPGRPQRRAAISSAARNPRPTMPVTAHSTTRGRRHAGNASRSPVREMSRTAIVFTVYRLPFSRCWVPCRRDFPGSRLRSRAIATRSVILAESGTGDGPTERRPARLTNVNAVVSVEGLSARQEKFAIWPGRIVTLAGIWVLLSFPLRMFSWTWTVDYAFSLLNVPAEPNLFIAAALLLLGSALRRRLRAAFILLLIYQICATVLDTITALVGLAYWDQPEQADLDLSRTEIVLTAVAVPIGLVVTVLVWRARRAFPARLAHASRRTALILLVAGLAAAWSLAFSLTWLFPDSLHGMGERVIWANRSALGLSAAGDNAGLHGHHGHHWVSVAASTVSALVLLGTVAVFLRSARSQQYLTAEAELQLRRLILESGDRDSLGYFATRRDKSVIFSPDGRAAVTYRVVAAVSLASADPIGHVGSWPAAIGAWRAEAHRHGWFTAALSASEAGANAYVESGLKALSIGDEAILEVSGFDLQSRAMRPVRRAVTRVRAAGYTGQVRRQAAIGADELAELDRLAAAWRGDGSERGFSMALGRFGDPADGRCVVVTAHDPQGRVRGVLTFAPWGVRGLSLDLMRADRQAENGLTEFMVAVLVEACPDLGVRRISLNFAMFRSVFSSADMVGAGPVTRLSDAVLSVASRFWQLESLYRANAKYLPNWLPRFLCFDSSLTLSRAVLAAGIAEGFLPSLSPAATALDADPAFLQQIRDQEDQLLRPAVPLRRLSQQQRARLDKRARLAEAYPVTVPRTVTLAEARTLPAGTGVSVTGRVRALRDLGGVLFAVLQEGDATLQAMLTADRTPDQERLRWRRTVDLGDHVSVTGAIGSSRSGELSVLADTWVMAAKCLRPLPDVHAGFTDPEARLGQRYLDLLVNPDAMQVLRHRSAAVRALRQAFAVRGFTEVETPMLQAVHGGASARPFRTHINAYDMELYLRIAPELYLKRLCVAGMEKVFELNRNFRNEGADATHNPEFTSLEAYQAYADYHTMRHLTRELILEVATAVHGRPVALRPEGPVDLGEPWPVLTVHEAVSKAAGASLTADTPVDEVRQVCARHGVHAKADATAGELVVELYDALVEKQTTYPTFYTDFPLETSPLTRTHRGDPRLAERWDLVAFGMELGTAYSELVDPIDQRDRLTAQSLKAAAGDPEAMQIDESFLTALEYAMPPTGGLGLGVDRLVMLLTGTAIRATLAFPFHRQARP

SEQ ID NO: 15875 - protein, 399 aa, Actinoplanes utahensis
MSGARVLVTGASIAGPALAHWLHRRGAEVTVVERAPGLRPGGQAVDARGVARDVIARMGLAAAVRAACTDTAGAHTVDADGQVLATFRADDDGGDGFIADIEILRGDLSRVLYDDTRDGVDYVFGDRIAELTQDADGVDVVFAGGDRRRFDLVVGADGLHSSLRATVFGPHQRFLRHLGHVLAFYSVPNEFGLDRWLLEYQDRESGRSALLRPIQDATRAMALFSFPAADFAVDHRDVAAQKSLLRERMTGLGWHTPAMLAHLDDTPDFYLDQVAQVVMDSWSHGRVGLLGDAAFSSSPMSGQGTGLALVGAYVLAGELAAAGWDPATGFARYETRMRPFVEANQEIGRLNARSRDLPGPDTTALPDFTGDWFADLAARAINGIDLPDYAETPDVARRS

SEQ ID NO: 15876 - protein, 107 aa, Actinoplanes utahensis
MQPSEQYATVPPTETAPIARAATGMLVVDAAGDEVGKVSAVQPPGTPVRPDTVAGVAEALMGSGYLRIDGTGALSNDTYAGGDQIVALEDGVVRLRVGRDGLHRAAS

SEQ ID NO: 15877 - protein, 358 aa, Actinoplanes utahensis
MTGRVLSKSDLVVLGAGVVAVAAAGVLHYSGATAVLAFVVAGVAVALLASLVGRSVEQLGDRFGPGATGVLQSALGNLPELFIGFFALQAGLLAVVQAAIIGSILSNILLVLGLAFVVGGVKHGTQRFDSDRARTSTVLMVLATAALVMPSLAQYVHAPAAGHEKALSLVVSVVLLGVFLLSLPSALKRSPVAEPSAPQPAEHAGPHWPLWLALTMLTGSSVAAALVSDWFVAALEPAITSLGVSQAFAGLVIVAIAGNAIENVIGIQLAYRNQADFAMAVIIQSPLQVALVLAPALVLLSLFTATTLTLVFAPLLVMAVAVAVLATAFIVFDGESNWLEGATLIALYAIIATTFWWG

SEQ ID NO: 15878 - protein, 166 aa, Actinoplanes utahensis
MTETHSAADGQYTTNGTPHGATGLTPFLVIPDARGAIDFYVKIFGARVVDVTEFGGTVAHAVLDFGDGLLQLGEPSPDYGLIPPPEGDRDCYSIGRYCPDVDAVVARAEAAGATIREAPATFVSGDRFASIRDPYGVRWSIMTRVEDLSEQESARRVAEWAAKQGS

SEQ ID NO: 15879 - protein, 270 aa, Actinoplanes utahensis
MTGGDPLEDSRQDPHPRGVLYPARLPTFTRLPAPGPVAHLVRWFWIPEWRIQPGRSSRQQLIAFPACNLVVEKDRVGLSGPTTRASHRDLIGTGWAVGALLRPAAVPHLVADPAALRDTYRMIDLPDLHEGVSRAMAGDGPERHRDAVDAFTAWLAARIPPPDAEALLANTMAGLIDADPAIRTVQDATARLNISARSLQRLAARYVGLPPLAMIRRRRLQEAAERLRAEPGTNLAAVAADLGYSDHAHLANEFRSVLGLTLSDYRQDFS

SEQ ID NO: 15880 - protein, 481 aa, Actinoplanes utahensis
MVLRFGRQAWSVYLAFCVVVMAACFLVPWESVKTVLTGLLGVSAVVATAVGVARHRPATRWPWYVMAAGWLFFAAGDVIYWVQSSVLGRDVFPSVADVFYLGSYPMLTVGLLGLVRARRPGRDRPGLLDALVLSTGAAMLSWVFLMEPYVHATDLDVLGRVVSLAYPSADLLLLAVLLRLTTGRGDRQPAFRLFVAAGAAMLVGDVVYGLMELTIGYHAGDPIDGAWMLMYAFAGAAALHPTMADMSRLSPPTAEGTIGVGRLIALALASLMAPAALIIEWFRGGEIDIPVIVSGCVVLFLLVIARLHGLVVLLAESLRSTEVQATTDQLTGLANRRRFHTCWQQSLTGEVGPTALLYIDLDGFKPVNDKLGHDAGDSILLGVADRLRGVVRAADVVARLGGDEFAIILPWTDDATAGTIAQRIVEDLAQPFEISGRAVYIGASIGVITAARGDNPNAQLRRADTAMYAAKNAGRGRVHHG

SEQ ID NO: 15881 - protein, 399 aa, Actinoplanes utahensis
MSLRARLLRASAALTLTVSAALVAGSPALAAAAPTTLPAGQFTLTADYSRFDALDAALVSKLGTASVSAVMADANHDRRGITDALNLAGYSTGFQFDDTDVNDCANFPQGITSSRDAIGTANSGNYDGHQLILVSWYTEDGCGGSTARSRITLVDWDATYPNRYRKILLVEPTGTAAAPSFKDVLVHAGGVAWYGDYLYVADTGHGMRVFNMKKILKTDTGGTADQIGRQDDTTYYAHNYAYALPQLGTITAATTSGTALAWSTISLDRADPSIVMTEYTCSSGCTAYPNRAARAIRFPFAPGATTFAASTTATEALKLPWFKLNGVASHNDRWWFNSSGDKKLYYWTPAAGPSAYAWVSGGESISYWEDTTKADLLWSLQEPVGHRNVFAVEQGSYDG

SEQ ID NO: 15882 - protein, 67 aa, Actinoplanes utahensis
MGLSGRECPDCGRSVREPFEQTVTGREVCPDCAKALFLGSAAGAVTGDVGAGYGVWAMLMRKVRRSE

SEQ ID NO: 15883 - protein, 404 aa, Actinoplanes utahensis
MTAIDEVITRVHRAEWARVVATLARRIGDLDVAEEMAAEAFAIAVQRWPADGVPPNPGAWLTTTAQRKAIDRLRREVRRDEIHREALMTYDPPGPLGAVDDDRLRLVFTCCHPALAMDARVALTLRMVGGLTVPEIARAFLVEEAAMSRRITRAKAKIKDARIPYGVPFREDLPIRVGGVLAVLFLIFNEGYLASDPAREPVRADVTAEAIRLTRLVRALLPDDGEVVGLLALMLLTEARRPARVSATGDLVTLTDQDRALWDRELIAEGHALVRARLAGGQAPGRYQILAAINAVHTDARHAGDTAWGQVVALYDQLLRLDPSPVVRLNRAIAVAERDGPRVALALIDDLPLDGYHAFHATRAELLRRSGQHDQARTAYDRAIVLSTNRAETAHLQRRRAGLS

SEQ ID NO: 15884 - protein, 110 aa, Actinoplanes utahensis
MTQYLMSVLNDADTRATEAEAAAIDVFNAKMRADGHWVFAGGLAAPGSATVVDARDGQPVFTDGPYLESKEHIVGFWIVEAAHLDEALRLAAAGSKACNRRVELRPFLGA

SEQ ID NO: 15885 - protein, 192 aa, Actinoplanes utahensis
MPQLMIIIGSTRPGRAGLPIGRWFAEAAAKHGGFDVQIADLAEIDLPLLADPHHPRLRQYVHQHTWDWSARVAAADAVVVVTPEYNYGYPAGVKNALDHLSQEWAYAPVGFVSYGGIAAGTRAVQQLKQVVTTLRMIPVVESVNIPFHAQHLTDGVFTPAPAAEQAATAMLDELVKVEAGVHRLRADVRATF

SEQ ID NO: 15886 - protein, 173 aa, Actinoplanes utahensis
MTATLGDILLVFLADRPGSAYDLKQRHEQTFGADRAVDVLRVAQTLSRQEKSGYVRPSTRALPPRSPRVFTLTDAGLRRQFGWLLDVPPDAAGPDVLDRVLLAMAATERATFDAVVARCLAVLEAQRPRPGLPRQDALSVRHARAELAVVMATSAIEWVRHLAQRPRERDAAA

SEQ ID NO: 15887 - protein, 243 aa, Actinoplanes utahensis
MTIPHLPSLAAASAAAFLLAWLSAVAGFGGGVLLLPVFTALFGLRVAVPMLTLTQVSSNAFRVLLNRRDLHWRLVAWFTAGAAPCAVVGGLLLAHAPLGALKRVLGVFLIGVVVWRRLRPHPGRPADPAFAAVGAASGLGSALLGSVGPLTAPFFLAYGLARAAYIGTEAASALAMHLSKIAGYGAGDLLTGQVLWYGVALTPATLAGAWAGRRVVGRISDRVFVTLVELGLIAAGLLFILGW

SEQ ID NO: 15888 - protein, 151 aa, Actinoplanes utahensis
MTIPPRRAGDLLTAWVDRLPPRLRRHLPRELAGFAILGWFTFTVDLTLLTVLRRHTSLPLPVAVSIAYLTALTLNFTLNRTITFRSHAPAGPQVLRYIVVMVGDYLLTVGVSTGLTMLGAPFAVARVAASFLVAILTYAASRWWVFRDRRT

SEQ ID NO: 15889 - protein, 164 aa, Actinoplanes utahensis
MKRIARVLAMSGPGLGAALVIAAGPAQAATVTAQPAVHSASVQAAGHWDDSDVVGYFRTRFGCERVGRLGEYHGRWDDYDCSRVWSGFNRGAWVLEVAADDWNGDWDDDNWYHGWYDSYHGGDFDGGWDHGGWHHDDGGWDGHHPDGSGSVAVFPLHSRARSVN

SEQ ID NO: 15890 - protein, 653 aa, Actinoplanes utahensis
MPSTPEPPAVDASWARLEAFSRLAGPLTVVPDDRPYRVAYRNQRAVDGRRHMINAAVIALCNVCFEVFFFAWLLRPDHIGPTHIGPAAQAARVANLVVIAAIAVVELLRLINVLSLSLASVVARDPVPVVPDDDLRVAFLTTIVPSKEPIAVVTDTLRAATRIRHRGTFDVWLLDEGDDPAVKAVCAELGVRHFTRKGNTGYNQPAGAFKARTKHGNYNAWLDAHGDRYDVLLSVDPDHVPLANFAERILGYFRDPDVAYAVGPQCYKNGEEFVTRAAESQQFPFHSVIQRAANRYGTPMLVGTNNAIRIAAIRGIGGLADSITEDMATGLAFHTSRNRATGNRWKSVYTPDVLSAGEGPSSWSDYFSQQRRWSRGTFEILSGTFWRRFLRLSPGAMLHYMLITTFYPSMAIGWLLGILNSVLFLGLGVTGMTIVARTWLALYTDATVFSLWLYIHNRRYNVSPYEPPNSWGLTGMLMSVIAAPLYAGQLCSTLLRRPAKFVVTPKGTSTSNDGLRTFRNHLGWLAVLTAAVAVSYVRGYASPASLLWPCTSLAVCLLPLTLWQAGPRLTRKAATTPVGRQPLPAPGPHHAGDITKEIPKAAIKELLSAGSKSGQRHEDRLPAPAPAAVDVPSQRTDSADQTPQPATAPRSHG

SEQ ID NO: 15891 - protein, 352 aa, Actinoplanes utahensis
MLIPTRRRRFTLALIAISAIAMALCCVKEFATDGHRRAPKPSTARPGAATSMLRENSALAQQHFYVDPHGRAATQAAQWQADGHSQQAALLRKIADRPVADWVTDGPIPVAERVGALVGRAEAAGQLPVLVAYNIPDRDCGGHSSGGAASAARYGEWIRGFARGIGNRPAVVILEPDAIAHSLQGCAESGERLAVLHDAVTVLKGNSSTSVYLDAGNPGWITDTRQLALALRRAGIAEADGFALNVANFYTTSDNITFGNGLSDALGGHIHFVVDTSRNGDGPAPSDDTSRWCNPPGRALGAAPTTETGQPLVDAFLWVKRPGESDGSCRSGEPPAGQWWPEYALGLAARAS

SEQ ID NO: 15892 - protein, 623 aa, Actinoplanes utahensis
MPPVWSAVSRWQHEKLINSAAYKSSHGFWQVVKLPAGSRVNAIHSAMLPSGKLLLIAGSGNDRTQFKAGTFKTLVFDPVSGNTKLVPTPTDLFCAGHAFLPNGKLLVAGGTLRYEVLQPDVTHAGGTMTVKNESPDGARSFPKGTVFVAANGLRYTSGDAFTVPAATKTVTPAAAGGKTKVAVAASSVDVWVDGAGDGVQYATGIRGQYRIDGLTGADARNVYGMTDRISMDKQDYQGRKEAYEFNPVTERYERVADMHEKRWYPTLTGLSDGSVLALSGLDGSGKVVDGTRNEVFDPKTQTWTVRKDLNHYFPTYPTLLQTAKPGVLFYTGSNSGYGPADRGRDPGLWNLSDNSFRNVSGLRDPDQLETSMSAWVGPVQNQTVMVVGGGGVGESRHSTRRIDIINLNDPTPHFRPGPDLPEPTRYPSLVNLPDDTTLITNGSRDYRGRGASDNHVARIYHPDTNTLSMAADPHIGRNYHSSAVLLPDGRVLTAGSDPLYADKKNTISGTFEQRLEIYTPPYLFHGPRPQITAGPPVVGYGQKADFATSSPAEIASVRLIRPSAATHMLNPDQRSLAVPFTTTAAGVRVTVPEQAALMPPGPYMAFVVNRAGVPSVARWITVH

SEQ ID NO: 15893 - protein, 107 aa, Actinoplanes utahensis
MNPTWQHSVQRDTATSTIALSGELDLAATATLNDLFAGQLAVDGIITVRVDLSAVTFLDSTVITTLIVARNTATAGNRQFTVTHAAGHVRRVLTVAGVLDTLTTDPG

SEQ ID NO: 15894 - protein, 185 aa, Actinoplanes utahensis
MRTPAPALARPVDRPAPTLDSRFAAAALTDLRHTVRTAAAGAGLHGERLDDFIVAVQELITNAVRHGGGRGRLLLRRYDNTVTCEISDHGSGFPGGVPPIVSPPPAGVPGGRGLWLATQLSDTLLITDRPDGVTVTITICLTTPGMPAGVTPAADSGTVPARQQSELAVMPGPPLLGSDGGSTPA

SEQ ID NO: 15895 - protein, 151 aa, Actinoplanes utahensis
MRIYYQDADITVAGAGVEVNGHLYPLGEIENAWRRGRRSVGRRGRIALVVLLAVIVFEVVVWALTWWLWAFRGLLVIAALLLIRVVAHLAAGSTGLQALEDLRRYGRRHQLWISVARTPICVLSTNDAIRYGQVCRALTRALNDYDITPSR

SEQ ID NO: 15896 - protein, 215 aa, Actinoplanes utahensis
MGPRGYAGRCGICPHDLLPGVKRAAILVTALIVAVAAVVGWRWWHHRPPFGPKAMNARATLHPADAAAVTAAFGPGRAIVAGDGDRTFLGEVTWTRPAHPRAGNSFWIVVLDKRAHVKPDMVAATSARPGDLFLGEDPVLDRAQARYPWLRGAGTVATGGGYVSRGNAVHVASVDAAPVTVEVVLPASRNPTDVLIALVSAGPDGQLYWAQRLLN

SEQ ID NO: 15897 - protein, 638 aa, Actinoplanes utahensis
MRRLAVAVLATAAVLVVPVGAARATDLTTAAPISAAGWAPTWRDDFTGDVVDPTRWGYDVGPGPQFGDAAERETYTDSRANAYLDGAGHLTIDARADCAAGSCAYTSARLRTGTLFSQRYGRFTARIQVPAGAGVWPAFWAQGDTGQWPANGEIDVMDDGAPGENGTVAHGGPIGPRGTTGTCTIRNGDGSTTADWYGVGGESRLPSGASLTGGYHVFSTDWYPDHISTWVDGLLYSIAFRADVVAAGCTWPFDQPFWLLLNVAVGGGWPGPPVDPPASGVYARMKVDYVEVSAPRDTPATAATGPIRGRQATADCLDVWHSGTADGTAVDSYPCNGSTAQQWTTATDGTLRAFGRCLVVTAAGQAQLATCTGAAAQRWIAESDGGLRNASTGTCLTTGTGIPAPLTLAACTRSRYPTQAWSPPPTPALAARWRLADGAGDTAPDTGGAGLQTLTCTNGVTWADGGATLDGADASCETASAVVDTRGSYTISAWARLTAVPAGNRTVVSQDGASLSAFYLQYDGTGKRWAITVPATDDAAAPVFAGTGGGPVRAGTWQLLTGVIDRATGTATLYVDGKPAGTPAAVTGAWRADHSLAVGRGLWAGAHGDYFPGSISDVRVYPYALDAAAVSALYATGR

SEQ ID NO: 15898 - protein, 210 aa, Actinoplanes utahensis
MTGWSREQMAARAAAELTDGSYVNLGIGLPTLVPNYVPDDVELVLHSENGILGVGAYPADDDVDPDLINAGKETVTVRAGASYFDSATSFGMIRGGKIDAAILGAMQVSAAGDLANWMIPGKMVKGMGGAMDLVHGARRVIVLMEHVAKDGSYKIVKECSLPYTGRGVVQRIITDLAVLDVTPEGLRLVELAPGVTEDEVRSKTEPELLA

SEQ ID NO: 15899 - protein, 255 aa, Actinoplanes utahensis
MHKVMSSAAEAVADIPAGATLSVGGFGLCGIPSVLINALVATGTGDFEVVSNNAGVDDFGLGLLLARGRIRRIIASYVGENKEFARQYLSGELEVELTPQGTLAERMRAGGSGIPAFYTATGAGTQVADGGLPWRYDSTGAVAVASPAKETRVFGGREHVLEEAIVADFGLVRAWKGDRHGNLVFRRAARNFNPLAAMCGKITIAEVEHLVEPGELNPDEVHTPGIYVHRVVALTAEQAADKRIEKRTVRAGGAK

SEQ ID NO: 15900 - protein, 251 aa, Actinoplanes utahensis
MNAPPDVLGRAGVLLRAISSHEPEGATTAELARLTAIARPTAHRLLTALMTEGFTDRDPGGRWRLGPELYLLGTAAAARYDVTAVAQPSVRRLAVATGESAFFSVRRGAETVCLLREDGSFPIRSHVLHEGIRFPLGVASAGLAVLAYLPAAEVDRYLSDNDLVPGYGPAHTPDRVRERISTTRREGYAVNPGLIVEGSWGMAAAVFDRRARPIGALSLTGVEHRFAAQRRPQLGRLLLEEAHRLSASDRL

SEQ ID NO: 15901 - protein, 42 aa, Actinoplanes utahensis
MTNPEERPPEPVERPIDLQDVPESERPEPPRDPEPEVPEPPD

SEQ ID NO: 15902 - protein, 259 aa, Actinoplanes utahensis
MRKIGVVLLLALVPALLAGCGAGRQARAAGPVGPRVLSEVLSFARGEDRPLPTTVWYLSGPRGTGTAAGRHPIVLFSHGLGGLPEQFTPLATQWAQAGYVVAAPAYPHTNGRVRVDAGDIGHQSADAAYVLAKLTTGKLAAHLDPGAVAAVGFSAGATTTLGLFVEGHPASLRAAVSVAGRRPATAFGGPAAPILFLHGDQDPVVPIGAGRAAYRAVPWPKQFVVVRGEGHGQYLNPGDPGYPSAAAGILAFLREHVPV

SEQ ID NO: 15903 - protein, 400 aa, Actinoplanes utahensis
MVRFMQVAPTDDATARHDARPEVDRLLDKVRAQLGVEAAWVSAFGAGELTILAAAGAAGEMRLPVGEDAGLLGSLCLRVLAGTLPEIVHDVRRHPLTRDLDSATDLAIGSYAGVPWRSPDGAVAGMLCCGSRHPDPSLDQRAVRYLSLIAELISDHLSGPLAEQRHSVASARRAVQGVLDSRAVRMVFQPIVRLHDGRAVGFEALARFDPGTFAGPDRAFAAASLCGLGVPLELLALRQALRRLPELPGDAWLAVNLSADALLDADVLDTLLAHGGDRLNVEVTEHAQVSDYDLLGGALDSLRRTGIRLSVDDAGAGYASLQHILRLRPDLIKLDISLVRDIDTDPVKTALGRCLNDFATGIGARLIAEGIETAAELARLRELGVAYGQGYHLARPGALL

SEQ ID NO: 15904 - protein, 193 aa, Actinoplanes utahensis
MSYPEPSPSDPTQPSTPPPYHPAQPPSLYAPPASSPPAAYDPYASPPPPSYDPYAPPQQPIYDPTQAYPGAGQPSAPPFDPGYPPQQPSPPYGYQAYAPVVMAVGMPTSGAAVASMVLGIIGILGFCLFGIPCILAIILGHVGLNETRNGAKSGRGMAVAGLVMGYLFVIPTVIFIAMGGIGGLSAIMNHTSP

SEQ ID NO: 15905 - protein, 121 aa, Actinoplanes utahensis
MSENVKVISEALGLGATAGPSSDAVLEAYRQFKKDLFPWVRGDAREALAADETDPGFWEVTLGSELTDSGAAEDAVILAAARRLAELVKAPPAAKYTVTVSGSEGVQIGDHNTQTNTFGAR

SEQ ID NO: 15906 - protein, 786 aa, Actinoplanes utahensis
MTHSATRSLAHGPDGTVNRARPRATTAPIASRFTPAVASSANGQTLRPRWPRPRRRQPVRLQPSLVTTTSISRVTSSGETARSRPSNTLAVVAEIESTRTMYVNAAARSVSPRITRAVFGSRRRRPSVQSGIPEGERSAVGRRSALAERWPFRNAGPVGTPFYPDIPVIVRLEIPSRTGTAFAVDVRLACSVVDLGTHVRHGVTDPREALRRHLERIRFDPVAGEPDMVAVFTRIREHLAAVPPVLPGLSVTLLAVERSDPVRWQPGVVLTGPPPVGPRSSPAEAEIARRERVERLRREAAARAEPPSRALVGEAPAQVRAGAEVSLIVHVARAAPAGPRVRSAAMRSWPIPPAGSEVTLVTHPSAGLTPLGPIQQAVRVPPDADSDPVRFAFRAGVTDVHRIEVTAWAGGTFLARLVFEIAVSDRAVHPETATKSATTAGDVDGVPGAVTMQVHQSGNRYTFQLHNSEYVFDPVTVTVDTAVDGVLGRILETLRRFARSDDPPPIAREWLRNAGVSLWDSLVPEAVREQYLRLHGRIGSFAIATGNDVIPWELLYPMTRTHDAGFLVRQFPVTRTLFNTGRSRRINIGQARFVRDVKGPANAEAEFQAIGRILSPGRDPARISDLDDLLALLSGGEAGLTHFACHAGYRDDGPAIAMTGGDFSPMMLATVRAKEMLAPTRPLVFINACRSAGAVPYFTRMMGWAQQFLGAGAGAFVGTLWDVRSRTAQTFAEAFYSGLSEGKPLGQAALLARRTVEDDYDPTWLAYTIYGDADALAFPVSEGRQH

SEQ ID NO: 15907 - protein, 170 aa, Actinoplanes utahensis
MKTTDDGVRVEDLIAAVKNAIDEANISTTDPSRDLRVSKVDLTLSVVASRHGGAGLELKVPVIGTKLGARYQHGTSGTQTVQVTLIPPPPSGFEVRGGDLEESLVEAITTIRAAIIAARTGDDPFVLESSVVTLVFAVTDTGSITLLGEGDLTDEQTSTLALTLVPADHP

SEQ ID NO: 15908 - protein, 886 aa, Actinoplanes utahensis
MIHPMTATDLPRSGPHDVDWAKLDRGTVVRTLLTDLTTDDPATRAAARRALCRNAPDGEDVRPWVTAALPTLLALVADPAQPERGPLLHLIADLAGADRTWQMSGETLRAKRLLAAHAAQSIPTSSAAAPATQAGPSAPTTLAADADRAASSTAVIPATQLALPRQTEHVGSSGNVRRVRPSGAALPSSDSHRRPRTNSANPIPGARQPESATAAEAVSPTGAPPASALAATPEATRGPAARAATEATPEAAARAATQAPPGAAARATTQAPPGAAARATTKAPLGSAAGTSAETPAEPAPGFLAALMADEDPLVRDAAAYLVRAVARLLPGLIELIWGRYVEEPDPAVRVTLVRSGVVAGAVGSGVEPTKVWLAWAADSDADLRVRITALTELMALLNPPPFDVETARETVLAAYKAGLNREPAPLDDAVAPLLAGRRMAARQWTPGYPQVVSVVRTSYRNDVRPQLDLLTRMLELDAADARQDALHEARALVRRLRAPYRPLVVRAAELLGDDDPQVRAAALRMLHGVGELARPAADDIWATLPPTRQRIRPGQSPWVQADLTLGPAVRTLAGLRDERVLPMLERLLDELPGTVDLHRFIAGYGARARGLSRTLRRLLRAVEPSASAQRLSFLHPETVELPRIAQRARPSSIAQRAAGLFGDDALRAALLRALIAVAPHEAADHLTYDPIDLTTLDLLARAGRSAAARIPEIRLALTCGDPALELAAAQAIWRVAGDAEAAASVYDRYFDDPATLPEHAVTALDGLRDLRLRVKSRTRRLVSLAKTRRNGAVVVAAADALWWIAGNQDAARTLGPVWESLPRARPRIARIWTDTGDARYAARYVKAELATTLRHNATLFGRPTTDINEDEHLLALCRDLLAKAS

SEQ ID NO: 15909 - protein, 285 aa, Actinoplanes utahensis
MIVCYAQGGGLGHLTRIRAYLHTVHDDEPATVVTSSPFGGDPRVLGPHRLACAPIADVLRELRPETLVVDAFPGGIRGELDASVIPPKIRTVHLARLLRWAAYRDMLPVDVTYFDQTWVLEELTDGHAAFLAGHSGAIGSLTLTDPPSVPAREIAADRWLIAHAGPLEETTQLLAYARECAALENVQPRLLLAAPSRPAPLPADVDHIDDYPVWPLFASAARVFTAAGFNAVRQMAPWRHRHRILPFARRWDDQFARAARVRPPAAHLLSDRTVDQSSWRRRDAR

SEQ ID NO: 15910 - protein, 361 aa, Actinoplanes utahensis
MRLLWVTENYPPSPGGMANSCDRIVRGLRRAGVVVDVVHLSRRAGAGRITPEQGGRLITVPLGEDAEHALRMLWTSLEAAAYTHVVAFGGTYPLLAAPVYAAWSGKPLITLLRGNDFDTGMFSLRRQPVVREALRSSAHVCVVASSTAPLVSALAPGVPVTWVANGIDADEWQVLPSESRKAAAWRAEHVTDGRRTIGLIGQLKNKKGVRLLLDALAPGRHDFHLILAGDLEPGMPLDGHPHTILPFQDRYQLLTVYASCDVIALPSFYDGLPNVALEAAALGIPLLASDAGGLADLVDETIGFRFRAGDPHGCRSALHRAAEATDEQLGALGEAAARRVRERFGIARETDGYLKVLAATR

SEQ ID NO: 15911 - protein, 94 aa, Actinoplanes utahensis
MAVAACPSCGRPICADHIAEGGMCPECAAARGQVSHPAAAAAYRRRAHRYRTSQEYSDVVWYSGFDTYDRAAFDPGAGATQDFLDDGDDALVDS

SEQ ID NO: 15912 - protein, 240 aa, Actinoplanes utahensis
MFWREQKAAIAGFHPLHQALIAQRGVAATLPAAGWAAFVTSLQQHAGLIRRRKWALPARTLDVVVPLILELCSDLGPEGTLSVTADLRGLDAPGKCGPEAPLAVRPPIRKATEAWVIDPWLRLRGDLRDGSVLEILVVDRERRRRITKRNPRGKYKTKQKRKLVQTIRVRRRLPKGADSRVPVTPPPGWIGVLVREGERRSVLAAAKLDPVPRSAQEQIDRILSVATEPFRWTSPMGEIR

SEQ ID NO: 15913 - protein, 406 aa, Actinoplanes utahensis
MPDDRRGPAREGGTPDDPRAGAPRSGGHRAAYIAFDRFPSTKGSAVHIRHMAGELFERYGGGLLCVLGGGGLPAYQFENGVEIVRFTEVIPNLLDRAEAFSAWVSDRLAPHRGTLRLVHVRDPWGALPALDAGGRLVYEANGLPSIELPYAWPLAAPTTLAKVRALEERCLRRAAAVVVPSYVIEAAVIERGVAPENVHLVPNGADPVPPDVPRPAAAPGRYLIYVGALQPWQGVDVLLRAFARLADLTDLELVICSSVSPARARPLVRLAERLGVSARVRWQYTLPHAEVAAWLTHAELSVAPLTAGPRNLEQGCSPIKVWESMAAGTAVVASDLPVIREVLGGYGRLVPPDRPAELARAIRVLLEYPAVARDLGQRARRHVEDGFTWKHARARLAAVYDRVDQH

SEQ ID NO: 15914 - protein, 307 aa, Actinoplanes utahensis
MVTGAAGFIGSRLVRALLGDGHDVVAVDAIERAGAPAAAAENAAALGVPLTHCDLATADLTGLVDADVVFHLAGRPGVRSSWGSGAADAHRDNVVATERLLAACRRTRPRFVLASSSSVYGSAEHPCTEDDPISPRSPYARSKAAAERLARQAAEDGLPAVVLRYFSVYGPGQRPDMAFHRFIEAGLDGEPAPLYGNGQSRSFTFVDDVVAATIRAAQVPLPPGTVLNVGHPVTVGVREALGRIGVLLGATPPTVPAGVARGDVTRTWAATGRAERLLGWRARTALDEGLAEQIAWHRSRRREHSHA

SEQ ID NO: 15915 - protein, 445 aa, Actinoplanes utahensis
MPMPDDRSADSEPLSDGGQAWSGEPTVGGQPSDGGRSWSGEPTVGGQSSDGGRMWNEEPLSDGRPSEGRLSADARPLAGLVVADFSRVLAGPLATMTLADLGATVIKVERPGSGDDTRSWGPPWGTHSSAYFEGLNRSKYSIALDLSDPGDRATALALAARADVMVQNLRLTGFGLDYASVAAINPGVVYCSITGFGPDADLPGYDFVVQAVGGLMSITGESTGEPLKVGVALVDVLTAKDATIGILAALHRRRETGAGDHVQVDLLSSLLGGLVNQASGYLATGRAPGRMGNRHPSIAPYETLRCADVPIAVACGNDRQFARLSAVLGVPGLAEDYRFVDNPSRVAHREVLVDALEAALAAETAAVWERRLTAAGIAAGVVRDIGQAIDRATDLGLDPVVDGQIRHPVRYANAATRPPAAPPRLGEHSDLVRAWLSGDPATGLG

SEQ ID NO: 15916 - protein, 377 aa, Actinoplanes utahensis
MKTTALQTICAGTMATGLLAFGGAAHAAMPPASPPAALREAIDEAVSAGNPAVLSYVRREGRSWQLAAGTADLASGRAAQPGDRWRIFSNTKSFVATVLLQLEGEGRLSLDDSIERWLPGVVRGNGNDGRRITVRQLLNHTSGIYDPGNDPVFGTDKGGHTPEQVVDAAMAHPPLFPAGQQWDYSNTNYLLAGMIVEAVSGHAVDKEIERRILRPLGLKHTSFPLTDPRIPGPHLHGYDMGYRDVTHFNPSGEWTAGAMLSTTADLARFDAALFSGRLLKPVQQRELQTTVFEQNYGLGVQQGTIPCGDAQVTVWQTDGGGPGFTSLSMTTPGAARQLVLVANVFDLGRDQRDIPGEDPTPDARPAYFKAITSVFCP

SEQ ID NO: 15917 - protein, 482 aa, Actinoplanes utahensis
MRGATESQQSGRHRACTDRLECGRLHVRSFVEVRLRLFRFDGVDSTRQSPQSTPGISRYPQRGLTGCSVPARSAILDAMKRFSYAMLGLPLGLFGLFYVAFAIVAGSALSFTVVGLPVLAAGLRGARLLGTLHHRLARRLLGFAGAGPTTPPTGAGFFDWLKTGLTDRAGWQAAVYLLIKAPLAVLTAGVAIFFYGYGIAGMTYPLWWKLVPIQDGHAGVPLPGNIYLDNWGRAALISSLGAGLVLAAPRMLRAVLLFDRLAIGALLGPGKLRERVRELEESRAFAVQDTATMLRRIERDLHDGAQARLVAVAMGLGDAKERLEQTNADPASRRLISKAHQDAKAAIVELRNLARGFHPPSLDSGLDVALTTLAARNAIPVELSVILPRRPPLAVETIAYFCVAELLTNVAKHSRARHATVAVRGERDRLRLVVSDDGQGGARPSGGLVGLADRARTVDGTLKVDSPPGGPTIVTVELPCGS

SEQ ID NO: 15918 - protein, 223 aa, Actinoplanes utahensis
MRIVIAEDAAMLRAGLTDTLVNRGHEVPAAVADGDGLLAAVAKHRPDVAIIDIRMPPTHTDEGLRAAIQIRRDHPDVGVMLFSQYVESRHTNALLRGGAQRLGYLLKDRVADVSEFIDALARVAAGGTVLDPEVVTQLFNSGASRGRLSGLTGREREVLALMAEGRSNTAIAEQLVLAYASVEKHITSIFTKLGLPASASDHRRVLAVLQYLRVETLTDPAAT

SEQ ID NO: 15919 - protein, 202 aa, Actinoplanes utahensis
MIGWAGSALLVWSLMQTRLLRLRALNLVGCLVLIGFNAALGVWPMVGLNVVLSVINVWYLVRMLATRHDEKAYQVVEVRPDDGVLTHTLQRHHDDIVRFNPDFVPQELGGREAAAFLVLNADEVAGVVVFHVADSGVAQVELDYVTERYRDFTPGEFVFRRSRFFADRGCHTVITPPGMQAPYYGRLGFKRDGESYVLELAG

SEQ ID NO: 15920 - protein, 354 aa, Actinoplanes utahensis
MSFSWPYALTALLLVPLLPAARWWFNRRRKRASLVVSDLGLVRAAVPGRGAWRRRIPAALLLCGMLALALGVARPQATVAVPRANASILLAIDVSGSMCSTDVAPNRLAAAIDAARTFIERSDRGTRIGLVAFSGTAGLVVAPTTDRKELIRAVGRFRTALGTAIGEAILTAIDAIAEYNPAVAASGVDLISDNSGGFQPDTIVVLTDGSNTTGVDPLIAAGQAAARHLRVFTIGFGTTTPGPMVCDPGQVTSGSFRGGPDPGGAGGGSASGQSLEIDEKSLVAVAETTGGRYFRAADAGQLNSVLTDLPAEIGLHRQKTEITMWYVLGGTLLTFTGLTLSLWWSRPSLKPTRK

SEQ ID NO: 15921 - protein, 217 aa, Actinoplanes utahensis
MGRLPAGHAAARLRAPKRTEAGRHQLIDAVCAVVAERGHENTRFTDVAQRAGTSIGSLQYAFGTRENMVATALDERTNRYLTEIQAAGSGIADPLARLRWLGTHLAAGLGGDDAARLEWLVWTECWRASLRDDRLKAASTAQYRNWIAMITEAIEDCVTAGVIAEPDDTHAIAAAALGMADGLGVQVSLSDRDFGWEDASRMVRSWLALSLNCPDLR

SEQ ID NO: 15922 - protein, 453 aa, Actinoplanes utahensis
MYEQADVVVVGAGVTGLTAATRLAAAGLTVTVLEARDRVGGRLLGAEVDGVPLELGGQWISPDQTAALAMAEELGLDTFPRYRDGANVYRDRAGVRHTYTGAALPVSAATARAIEAISDEVERLAAETDPDRPWAHPDAERLDSISFADWLGMRTDDQEARDNVAMFLASAMLTKAADEFSTLSALHMAASAGGFSHLTDENFVLDRRVAGGLSQVPRLLAERLGDIVRLNSPVERITWDADGATVATADGSVRGRRVILALPPTLMGRITFEPALPEAQRQAQAHQSFGTVLKIQVAYPTPFWRAAGLSGTGFSPYQIVHEVYDNTNDDRPEDRRGVLVGFVSDRHARALLDLSPADRRAAVLNSLASYFGDEARQPVAYSESPWLDEKWTGGAYGTSFAIGAFHEYGRHLREETGPLSFGSADVAGLGYLHVDGAIRVGEELANASIKALK

SEQ ID NO: 15923 - protein, 326 aa, Actinoplanes utahensis
MIHVVLLLACAVVIYLACEWFVNAVEWLGVRLRVGPLAVGTILAAAGTALPESVVTLIAVLFGGGHAGDDIGVGAALGGPLVVGTIAYAITGLMLLIVKMPDLGGTDLTRLARDQTWFLAIFVFKIGLGLVAFALKPWLGLLFFVAYAIYFRKETADTGDAGIVDDLEPLKLQPRRESPATLAVIVQSLATLVVIFLASQLFVRQLAWAGPAMGLSPVVVALLLSPIATELPEVMNAVIWVRQGKTPLALANISGAMMIQATVPSGIGLLGTAWRFDTPLILAGTATMLSVVYLLILFRTGRVTPRLLCVAVVFYLLFAAGLIAAG

SEQ ID NO: 15924 - protein, 307 aa, Actinoplanes utahensis
MPFRIHAGHLAALRARLGRIAAGVGEFEQDQAAFGAWCGWILTGLGDRVVRHGELVAYIEETLLLFVQGFHRVADGSETFGAMIGMPVDEDITVYDSATEIIDGVLDTVAAREWVEPLLAEAAPVAEFAAPVGDLVGALRVGGLHWAVTHVPELRQMLDDLAGAPDVVARQADRWGRMATELERIADDLQRCLDHDFRGRSSPEVRGYLAIMSNNVVGLRGLVATSTAMTALTKAAGDLILLTRDIVRGLIGDLIARVAGWSLESEVVPLPLLTARLAVVATTVRRVDAYLNALVVSIANLSRSIGG

SEQ ID NO: 15925 - protein, 262 aa, Actinoplanes utahensis
MGMLRLYRRLLGAHLRSMLEYETDFWLLAGATVLTQVVNVVFLSALFARVPRLNGWSFWAVVMMFGAVAVAEGVGSLFFEGMWRMAWQVNQGELDYFLVRPYPVVLQVSSAEIGVNGASNIVTGGLMLGVGAAHAGVDWTWWRVALAVLLLAGACVIKVSINLATNAAVFWLSSPTPLFGFAVHQIGDLARFPLSIYPAALKMVLGVALPFAFVSFFPVAYLVDAGAAPWVGVLTPLVAAYCLGAALLIFRRGLRRYESAGN

SEQ ID NO: 15926 - protein, 262 aa, Actinoplanes utahensis
MRAYRALARATARSALAYKNNLFLGLGAVFVQFIAMLAVWRVVLADGSAVQGFGWPQMRAYLLVAFAAGTLVSVFGDFRTAARIQSGLVALDIIKPVDFQRARLAETLGGTWLEALVVVVVGGVTLALTGGVPTPPGAALALFAASMLMLVPLKFLIVYVSTLACFWTQNFIGVQWARIALVNLLSGALIPLAFLPGWLAAVAQWSPFAGLVSTPALIFVGQVGVGRGLALVAAQLGWVVALWFGARLIWRAALRQLTVHGG

SEQ ID NO: 15927 - protein, 339 aa, Actinoplanes utahensis
MSIVEARGLTKVFRRPDKGPGLTGSVRHLFTRRYQDKVAVDRVDLSIEAGEAVAYVGPNGAGKSTTVKLLSGILVPTAGEVRIDGLHPQRDRTAVAHRIGVLFGQRTQLWWDLPVAESLAVLRDIYGVPDAAYRARLARFEEVLDLGGILPIVGRKLSLGQRMRADLAAALIHGPQVVYLDEPTIGLDLAVKDRVREFFRTLRDEGTTVMLTSHDLADIEGFCRRLVIIDEGRIIFDGDLQSVKDRFARERILHVETEQPVPLDTLAAALPGAAVTAEETPTRFAVRFDRFAMTAGQAVTAVAGLTSLVDFRMDEPGIEDVIRRVYSGELVLDENRAAR

SEQ ID NO: 15928 - protein, 282 aa, Actinoplanes utahensis
MPRIAVTGGGGKLGRAVVQDLLDHDFEVVNLDREPPRDPVCPHTRVDLTDYGQVAEALTAIDSRYTGIDAVVHLAAIPGPGVATNAVTFANNITASYNVFAAARAAGIKRVVWASSETVLGLPFDTPPPYLPVDEEYAARPETSYSLAKHLDEQMAAQFCRWDPELTMIGLRFSNVMEPDDYAAFPSFEADPRRRIWNLWGYIDARDGAQAVRRALSYDRSGLEIFIIANADTVMSRPTAELAAEYFPELPLTREIGEHQTLLSIDKARRLLGYDPRHGWRR

SEQ ID NO: 15929 - protein, 52 aa, Actinoplanes utahensis
MNPARRKYRRITFMMSDAAADLGSSLRWRPGHDDPAAGAARAIIATTPRGSC

SEQ ID NO: 15930 - protein, 281 aa, Actinoplanes utahensis
MSPNRFRKRIALTAAVAVVTGGALLIVQNSFAATIPGAGGSTAGRPATSAAAGTAARPGAATRALPGAGTRVASTGDQAGKCPDVHIIVTRASTEAPGTGIIGSLATAVTRASRQTVTVEATDYPAALNPYPPSVAAGTRALTAQVTAEAGNCPGTRIVLMGYSQGAHVIGDVLAGTGRVAGFTPNAALSKKTTDHVAAVILMGDPRYVPGKSFNAGTSKTRGLFPRGGDAPLDAFAARTQSYCDTGDTFCAGGRSVAVHLSYTRRYNTAARDFVLNRIGG

SEQ ID NO: 15931 - protein, 314 aa, Actinoplanes utahensis
MGRGAEAGRMGPLLVLLSAACFGAMAIFGKWAYDVGVTPGTLLLVRFTLAALLLAMVLAAGPALRRMPPGGGRGRAVLTALGLGAVGYAAQASLYFAALERMDASLLALILYTYPVLVTIGAVLLGRDRLTRGRAVALAAASGGTLLVLGGAGGTGFRPVGAVLAFGAAVTYTGYILVADTVVRRLPPVVLSALVMAGAAVTLGVRALLTGGVHFGFPAAGWLWLGCIAVVSTVVAMLAFFAGLRRTGPSAAAILSTFEPVVTGALAALTLGERLTPVQVAGGVLVLASVVILQTGPGTGRSADRVRRDGRVAA

SEQ ID NO: 15932 - protein, 89 aa, Actinoplanes utahensis
MVALDLRRLRFLREFEERGTLGAVAAALGYSPSTVSQQLALLEKEVGATLFARAGRGLRLTDAGRLLAGHARVLLAAAEAAEADLAAPS

SEQ ID NO: 15933 - protein, 180 aa, Actinoplanes utahensis
MEISELELEQALPSLRLGAVDLVIGDEYDGHPRPRPAGLRFTVVLAEPLRLVLPAAHPLARAGGPVAFADLHSAVWTSSAEGTGHHAMVVGTCRALGGYEPDLRHRSNDADVQLELVRAGAAVALMPPLALPVADPALAVREVAGAALGRRLMAVTRQSAAAPALHAFLDAVRAQARSIA

SEQ ID NO: 15934 - protein, 291 aa, Actinoplanes utahensis
MLKLLAIVMLIVLGAARPAYAIAYGETAEDGRYAFSTRLTMTGIPTEENGTRDSWCSGALIAPRWVITAGHCFRDAAGRHVSRTVADRTTATVGGQEIEVVAVVQAGGADVALARLAAEVTGVTPLRVGDTAPAEGEQVRLTGFGFADDQGTVPARMQTGQFVIDQVGEQLLQISGRAPRRATSACLHDSGGPYFRERRGGAPELVAVVSGGPACPHEGPDSSARTDTLAGWITATVTAAPGPDVPLIVVVAALGLLIVAGVVTGVRRWTAPAPGPRRGRHAGRVPQRTAV

SEQ ID NO: 15935 - protein, 265 aa, Actinoplanes utahensis
MTIASSFSTAVDASGRVVRASSATYLCDLYQCFGVVGKSGATGGRGVRVLVAEDERILADTIAEGLRRFAMAVDVVYDGDSAVERLSVNRYDVAVLDRDLPGRSGDDVCRHLTASDAGTRVLMLTAAVGIRDRVEGLGLGADDYLTKPFAFAELVARLQALSRRPSTALPPVLEQDGVVLDITRHTATRDGLLLSLTPKEFAVLHVLLRAGGRLVSAEDLLEQAWDENADPFTNTVRVTIMTLRRKLGDPPLIHTVPRAGYRLGA

SEQ ID NO: 15936 - protein, 239 aa, Actinoplanes utahensis
MTEILLDDRGTGKPYLLLHGGGGVATMAGLAGRLAARPGTRVLLPTHPGFAGTVQPDGLRSVGDLARAYVALLDERDLTDVTVVGNSFGGWLAAEIALLRSPRVSGAVLINAIGIEVAGHPVADVGAMTPAELAAHAWHDPSRAPKPPAAGGTGPSPDILALVAYTGPVMNDPTLLDRLRTLDLPVHVIWGASDRVVDVAHAEAFAAALPQSTLTVLPGSGHLPQLETPEELVAALLGD

SEQ ID NO: 15937 - protein, 148 aa, Actinoplanes utahensis
MEQGAQVVELGGGEGGEGRRDDLVGELLAGGPQAFALRGEAVSDGPARPGHAFDQAAVDHAGGQGAEGLVGLEGADGQVVQRGVRVPVQVAQGVPLGQGQAQWSQCRGQGAVVAVLEAFDGQGDVGGAVGHRWMVTRETQVAYISFLI

SEQ ID NO: 15938 - protein, 276 aa, Actinoplanes utahensis
MSQPGSPANRATSDPLTANPLDNQTEDGLRDLIAKVPAVTVGFWVVKVLATTLGETGGDSLSMSMRLGYLVSTMIFAVVFVAAVILQVRATRFHQWVYWFTIVATTTLGTTIADYVDRSLGLGYPGGTTILVICLACSFALWYKATGTIAVTSIQTPRTEAFYWLTILFSQTLGTALGDWTADTIGLEYTGGALLFTALLAILAAAYRWTRLSRTLLFWAAFVLTRPLGAVVGDFLDKPIAKGGLNLDRYAASAALLIAIVAILFARRQHPATRPH

SEQ ID NO: 15939 - protein, 132 aa, Actinoplanes utahensis
MALDGQVSDPYPDTSENTGVTEGHAMTTTTVDVNTSTDGTLIIHPHGALDATDAVGLSRTLVQAIRRTRPLRLILDLADVHDLDPINLGTLAAACHLGDDHQVAVFLDHSSARIAEELTEAGVPRHRLRNII

SEQ ID NO: 15940 - protein, 42 aa, Actinoplanes utahensis
MSYSRTPVSTARIPNRRLTGIGLALRGYVAILAVTATQMTWP

SEQ ID NO: 15941 - protein, 277 aa, Actinoplanes utahensis
MSARRPILSHLFLICWAVLTTLPLLWAVLSSFKSDTEILTDPWRPPSRLRWENWTRAWTSAHLGRYFVNSAVVVTGALTITMLFGAMAAYVLARYRFRGHRIAYYAFAGGMMFPVFLALVPLFFVVRDLGLLGTLPGLTLVYAAYSLPFTVFFLTAFFRTLPGAVAEAAMVDGCGHLGLFFRIMLPMARPGLLSVGIFNFLFQWNQYVLPIVLMQGEGAESRWVLAQGLTALAVSEGYRGDFSGLFAGMTIAMLPVLAAYLIFHRQVQSGLSAGQLR

SEQ ID NO: 15942 - protein, 301 aa, Actinoplanes utahensis
MRGRRPFIAAFLIPSLLLYGVFVVSPYAQAFPIAGTDWAGLSPSYDFVGLDNFRRLLGDAYFWTALRHNGLLLVLLPVVTITLGLFFASMISVGGRGDRAGIHGVRGSGFYRVVYFFPQVLSVAIVGVLWKQMYGPNTGLVNGTLRAIGLERFTTPWLGDPRFAFWCVFAVLVWMNVGFYVVLFSAAMQAVPRDLYEAALLDGANRLTTLVRLTVPLLWDTIQVAWVYLAIIAMDGFAIVQLVTDGGPGSASDVVGLRLYRTAFGDGRFGYASAIGVAMFFLTLTVAAMFLRVTRRETVEL

SEQ ID NO: 15943 - protein, 468 aa, Actinoplanes utahensis
MEYDVSRRDLLRCAAGVAAVGALGGCALGGGDVPGDPTVTRPVSAANPLGVPADAPLEVVIFNGGFGEDYAREHEARYRQRYPRARIRHSATQQIAETLQPRFVAGDPPDVVDNSGGSQIDFNALVGQGALADLTDLLDAPSLDDPTVRVRDTLLPGIVEVGSYGGRFLTLNYAYSAYGIWYSRKLFEARGWSYPRTWDEMIALCRRIKAAGIAPWTYPGVHARYMSWPILAAAAKLGGLGVLKAIDNLEPGAWRHEAVRTAAEAYRQLAVDGFLQPGAAGMDHIQAQTEWCRGRAAFVSCGSWLENEMRSVTPPDFAMTVAPTPSFTATDSMPFTAFRGTGSEPFIVPAKAKNVRGGLEYLRIMLSRTAAAAFTTRVGSLTAVAGATGGQPLSAGLTAVTAMVDASRGSAFTWLYATYYRKLERERVNAATLDLLTGRCTGAQWCDRIQRSADECAADPGVKKYQRV

SEQ ID NO: 15944 - protein, 410 aa, Actinoplanes utahensis
MVRLVLSVAVGLVTGLPAVTPADVAFRHDVLRPGTAAQAGLRPAPIGELRDVAAAHLRPTPDHPGHPSYAGATVLAAHHGIVVARFAVGDAVRYTATAAGIAELPPARRVPARVDTIWDLASLTKLFTTIVVLQQVQAGRVGLDAPVAAYVPEFAAGGKAAVTVRQLLTHTSGLPAFRPLYATEPTPAARLAAALRTPVTPGTTPGRQYVYSDLGMIALGVLVERVTGRRLDRVVHDGVTGPLGMRDTGYRPGRAARHRIAATEYQPHVHRGLVRGVVHDENAWALGGVAGHAGIFATVDDLAVLCQTLLDGGEYHGHRILSAAMVRAALTANPGGRGLGFELAARTYMGGLTSPVTFGHTGFTGTSVVIDPVRQSFLILLSNRVHPDRAWGTDTAARRALADAFAAAHP

SEQ ID NO: 15945 - protein, 416 aa, Actinoplanes utahensis
MLNRRGFLAGTVALSTGAGASAPPSRVPVVTGSDRLAADGWAPLKGQRIGVVANPTAVDRRYRHVVDLMHAAGIEIGGVFGPEHGFRGSAQAGGGEGTGTDARTGLTVYDAYAADPQRWLAMFRAAGVRTVVFDLQDVGARFYTYIYTLYDSMVAAARLGLRYVVLDRPNPIGGHAAGPMMTDGYTSGVGRLRIAQQHGMTVGELARFYDGEFVPAAAGRPARPEVISCRGWTGGLRAGDTDLPWVLPSPNMPTPDTALVYPGTGMVEGVAALSEGRGTTRPFELIGGPGFGFRWHDRVAALGLPGVAFREAYFTPTVDKFAGRLCAGVEIKVIDPRAYDPIRTAVGMLTEARREAAFAWRVDSGATYWIDLLTGSSRLRTMIDAGAGVDEVTGAWAGELAAFDQRRQPYLLYARR

SEQ ID NO: 15946 - protein, 298 aa, Actinoplanes utahensis
MTGRQGGDTIVVRARGLLPALSPAEQRVARVIVEEADTAARLTITGLAERAGASETTVIRFCRAMGFNGYSQLRLTLAAEAGRASGAAGDDEPVGSDISQSDDLGQVVKKIAFADARAVEETATQLDLAVLEQVVDLIAGARRVDIYGVGASAFVALDLQLKLHRIGRVAYAWSDTHLALTSAALLDERDVAVGISHTGATIDTIDAFAEAGRHGARTVALTNFPKSPITRVADLVLTTAARETTFRSGAMASRLAQLTVIDCVFVGVAQRTYQQTRAALDATYTAVQPRRLGADRRH

SEQ ID NO: 15947 - protein, 301 aa, Actinoplanes utahensis
MRHVEEASLSRTEERNPRSTTMDRMSTLDLLCLINAEDRLVAPAVTAVLPELAAAVELAVSALTDGNRVHYFGAGTSGRIAVLDAAELIPTFGLAPDRVVAHLAGGLPALTRPAEDAEDDEFAGAAAATAVVAGDVGVGVTASGSTPYVRAALAQARAAGAKTVLISANPASPMAAEVDVHIAPDTGPEVLTGSTRMKAGTAQKMVLNAFSTATMVRLGRTWSNLMTDMLASNAKLRDRQIRILAEATGVSPASCETALQEADGDAKVALVALLADVGIDSAARALTTVDRNVHRALRLLL

SEQ ID NO: 15948 - protein, 369 aa, Actinoplanes utahensis
MSADLRPATWLDAPIGLAPQVSLVDGADGNPLLFDAETGTYVRLSRTGARLVPLLDGSRTGVALLDAATRSRGPDGVRDRSPALLSFLTDLRAAGVLTVAPEPRRGRRRWFPWLIRLTPRVRIPARHLNLLLRPPARLLTRFPRGALSTALLLAAAATAAIALALLAPGPPSFVGPPWLLIVGALVVQAAVHEMGHATVCQALGVPVREAGIKLFFWLLPMTYVDRTDAYRVRSRTGRAAVALIGPLVDLLAAGLTGLLVLTAPDRFADLRWLLGMQLFVVLNNLNPLLPLTDGHHAMEAAMGELNLRDRAFRYLGHVLFRMPLSAAHQAVSATRRGIYLLYGLVSAAYLALLLTMIGTNYYRLLAAAF

SEQ ID NO: 15949 - protein, 96 aa, Actinoplanes utahensis
MHTEMTGPEISEDLDLWLEDDLTAEQLPTVISASLLGCGGCGGCGPCGPCGPCGPCGPCGPCGGCHGCHGCHGCHGCRGCHGCGGCGGCGGCGGCR

SEQ ID NO: 15950 - protein, 241 aa, Actinoplanes utahensis
MTTATQHDRQRLLEHLLADTRLDAAAAVRPLPEVPAQTAAAPADGPLITLPPPAAPRATLTATLADRSAARDFGRTPMAAADLCALLAAADTMDAGSWPGERAAGVDLEIHCAVWRVDGVPAGLYRYPPAGDSLIRVADLPEGPAAEELVMQREFAGAAAVVVLTGNLAAALARHGSHGHRLLLTRAGAAGHAAWLAAIRLGLVGSVFAGLLPHVLKELAGADGYRRAALFAFAAGHPGGS

SEQ ID NO: 15951 - protein, 528 aa, Actinoplanes utahensis
MIGTEEATRNDGRLSAAYMAYAVASDPQFTVPRRPCLIPGLVVVRLEDGLAFAGSGNRQTVLRGRTAMTLIPRLLRLLDGTRTVDELPEKHAAACVSMLYVSGLLQDGPAGGEAELIPAEVVDYLGRNLDTTRVNRSRGEAAARLARTRALIAGPERLTGPLRAELAAAGVDAHPFHPADSLGDGDFVVAVDDGNLAGIDEACRRAGVGWLRTAAGASTAEIGPMFDAGHTSCLRCFAEGRTAPAGEPSPARAAIWAALTATEVVHLLSRVGLAPSTAGCTAYDLDDWSQTSTGAYRRPGCPRCLPGTEPAEPALAHVYEQAVAFPPREWLNPKDHQAHFRPANAALQRYNKEYRSAPRIPLADAPFADLAGLLLRTAGLKDAGERVTRWAPTGGNLGSVQAYLRADDVPGLDPGWYFYQRGDHSLARIAGPSAGIAPALEADRPAALIVLTGALPVVAAKYHDFSYRLVCLDAGAALAQLSAVAAETGLATRIADRWDDQAISAALRIDAVTEPVTAVVAVSRKDPS

SEQ ID NO: 15952 - protein, 209 aa, Actinoplanes utahensis
MYHLRVSPVGPFGYAVAERLRDLCPDVSITDPVDRAAPAAPKGPTLHLLAAWRRVPDTERAFDERAHRTGDPWLPVILDHPVLEIGPAVLPGVGACHGCYRLRLAQHDPARTVRAAVDRHYELDPDAGPAGYLPSTALFAAAAAAEVVQRLRTDPEGEAGRVRQIEVPTQQLRTGRVVGVHGCPRCGLGRDEQTRSYDRLPEMMRGVLA

SEQ ID NO: 15953 - protein, 439 aa, Actinoplanes utahensis
MSAVAAEKAQRRMDLKDLVSPLGGLITHVMPLPVEPSEPPLRVHSADLGDVSTVISSACGPDCLGSLDGTGTGVDPERATVVAIAEALERYANILYDERQIRWATADELGAEALALDTLPRCSATELAAPDCPVVSPDPSAPIRWVRGMNTRTGRLCWVPAALVYMHFSAHGAERITNPISTGAAAHPDPARAISGALCEVVERDAISLTWLQRLELPRLVLDTVGPELQRYLDLCAGRNATIHLFDATTDVGIPTVYGVSVAPEHPSCRIVVSCATSLDPQVAAAKAICETVSVRIALHDARPPSDDVRTFTGVADGAAYMCAPERAEAFDFLLDSPARRRLSEMPDLSTGDARGDLRVVLDRLAERGLDAYLVDLTPDEAVRAGMTVVRAVVPGLLPLSFNYRARFLGTPRLYEAPARMGHPTRSEAELNAWPQPFA

SEQ ID NO: 15954 - protein, 584 aa, Actinoplanes utahensis
MTSDVDDVSTPEDVTAAAAPVAVTRGPADLWSRHRSWLVPLAVVAFLAQMAVGMVTAARQESTTVDEVAYLGAAVTYAHDHDLADNYEHPPLTKLLEATGLAFVDVKRTTHFDGDQWALGEHLLYDSGNDAQELLFAARLPMIILTLLFGLVVFAFARDLTGPAGGLLALLLYAFSPDVIGYGSLAGVDLPTAGFLLTALWLLWRARSRPYLHLPLAGVALGAATASKATALPGLLVGAGLAVVSVWFAGRAHHLGRPPVLRLLLIGVAAAAGVVAVAIATVWVTYLIVDPHLHWVTPRSVGPVHGLKGELFNLLPLPRPFLDGMRLQLGLEKGTYSSVLFGDFQNGARWYYLPGALLIKEPLGMLALWLIGSVAMLRSAKLRPAALYLLLPTAVLTATAMAGNRNWGVRYAIFVPVILAVVAAAVLVYRNRWPRVVVGLLAAFVAISSLAAFPYYLTYSNEAFGGPSKTYLQLTDSNVDWGQDMSRLGDRLARRYPGEQAWLIYKGRGRAAYYGVPGQNPLVLPPAQVHGLIAISVRCLTLKSACLPDASVISAKKARANFNELLATSTRIDNVGNSIFIYRR

SEQ ID NO: 15955 - protein, 64 aa, Actinoplanes utahensis
MIRDLVRRSLILLLAALGACRRVPPSPVDLPVVATVPVADRTRVLNAQTTVSAGASRAPPAFAV

SEQ ID NO: 15956 - protein, 238 aa, Actinoplanes utahensis
MLLADSIASVAIWLVLLLFALPALLLLANPQAVRHPREFALEALGLARSRREAAELARYAEEIQVAADRADHAAQRWQEHRQRAETHAADTWHAWQAAEQRLTRARAAAAFAPPDSPRTAAEYADRERFLHRSVRAAVDRGDLPSAALPAAIAGRDGWNPRLHPADQELILLTAVTAHRRTIHRQATVAERTAAHDARLAAATRHSLRREAATLRRFLPAPERRTAPSLARAWVQRTA

SEQ ID NO: 15957 - protein, 220 aa, Actinoplanes utahensis
MAGMTRPVRVIVVDDDALVRAGLTMMLDGAPGIAVVGEAADGDEVAAVVDAHAPDVVLMDLRMPRVDGITATRRVRGRPRAPEVIVLTTFDTDDDILHALRAGASGFLLKDTPPARIAEAVRQVAAGEPILSPGITRRLMDRVAVQAGAYARARNTLAALSPRERDVVVAIGRGRSNTEIAAALDMTLATVKTHVSHILTKLDLDNRTQIALLAHDAGLA

SEQ ID NO: 15958 - protein, 548 aa, Actinoplanes utahensis
MPIRVSVPVAPTALPSGPASDSSNTTKAMIRYVRVACRVRRSRTVSSAQAARPASSAVITTAAGPMWVVPPLERTVRSVPPHGSVTVHRSRAPAAPAATVIARPARRRAGRGQSASVAVAGRCVWFVMPMSLADPAGRPHRTEVGGAALLSCSLSYFGRCRRRQRRRYGDRVKTNGAVGMVLGVSGALVTATVTGWWAGRPMVAPLLTLDVVAGVLACLITPLMLWRPVPVAGVLAVLAALSPAASPPATIVALHVARRHRFPVGLAGAAAGVVAHAVQGWWRPNDGMSYGWWLALVTVGYGALLGWGAWWRARDELVRSLRERARRAEAEQGRRVAEARMLERRKIAREMHDVLAHRLSLIATFAGAMEFRPDAPPERVAAAAGVVRDGVHQALEELREVISLLRDDTPADDDGSRPQPVLADVPRLVEESRAAGTEVRLRDTVAEPGQAPPAVARTAYRVIQEALTNARKHAAGRAVRVELRGGPGAGLLIDVRNELAPDHPTPPGWSGGAGLVGLTERVHLAGGHLDHESTAGEFHLYATLPWPR

SEQ ID NO: 15959 - protein, 280 aa, Actinoplanes utahensis
MGDGGDAGAYDPAMRLLVIGGSGLLGREVVRQARLAGHRVTATAFRRPTGPRLDIRDRSAVAALVAADNPEVVVNAAYLQSDWATTADGGMHVAAAAAGCGARLVHVSSDAVFSGRAPSYAETAAPDPVTPYGAAKAAAEVAVRGLVPAAAVVRTSLIIGAGDSVTERHVRDLATGRRSGVLFTDDVRCPIHVTDLAAALLEFAARPSPGVHHVAGAEAVSRHRLGVLIARRDGLDESALRTARRVGSGLPGAVDVRLDCRATQRRLVTRLRGAGEFLSL

SEQ ID NO: 15960 - protein, 166 aa, Actinoplanes utahensis
MVRRGGCGCTKSDFPEDDGGRNPHFSVADGIKRRVYGCNERRGATGYAAAVTAATSFRLTPMRPRDPGEPGRTATPLELFFDLVFVVAVSIAAGELHHALSDDLAVPLGALLVLLDPITGVPVLLTAVIMVAVVAVLVLRPPLSERQKLTGPAQAGHQPALRRTTI

SEQ ID NO: 15961 - protein, 192 aa, Actinoplanes utahensis
MHPQPPRRTTHAHGTPHNRLVYDRWGRFGRPVVLLHGLFYDRTMWWPVAAELDAGCAAVAVDLPGHGESAPRADLSRLTEDLAALIRGLDLHRAPILVAHAGAARLARAFAEKYAVQHVLTVDDGTDTDLSVVPAAYRQFAVPRRPDRAVTAAYREWAAVPVGAGHPASRAEGTFPHLRDPAAFAALLHNLV

SEQ ID NO: 15962 - protein, 370 aa, Actinoplanes utahensis
MRRRRRTCCAPSRPPRSAAPWPACRSASAACCGRWRPTRTRGTPRSAPGWTSRSARSGRPGHVLWAGYAACCSTRIGPLTTLTSVDLDWGRTTHAYGPAVATPGHLRDLTAVEPAARARALRHLYHEVCHRQTIHPATGPMVEAVAGILADDRLGVPDPDAGRSMRASLLALLGEVGAWCGGYASESESTMLAIRRDDPEAAAFPEVWDDFEGDPAILIAGPVQAACVRRAPAVLAALTPWLDADDPHERGRARYAAACWAALGPPVPEPVIARLREIATGDGCRDVRVDSVLGLAGAGVDTGVLLDDPDRLIRTCAALSPAMAGDPRAVALVEAALIDAPDGIRWEPPPPYIAFGLENRLAALAPGWPG

SEQ ID NO: 15963 - protein, 335 aa, Actinoplanes utahensis
MSSRGRGIVVYLAIAFGGVWPYLFVVRLGFGWSLVDPLVQLPVAFVPAIGAAVVRRWVTREGFATAGLRLRAPWRLWAAGWLAPLAATAVMLGCAYSAGWWRSGVGPAGGPGGVPMLLAVQVVLIPAYFGEEFGWTSFLWPRLVPGRPRLSLLATGLIWAFWHYPLAFLGYADFTDRAVSIPLWTVMFLLFEVLLGWLYAGSGSVWVTSLAHSGNNVVMSMVSEQLLGGLTSVQTLICTDLGLALLCLPLLGSPVFGTGPGGRMNECPPVERRNSPDRMTPGISPARNSRDRRQASGVGDRRSCPAGDRREVGGDGYATGGGGGSCHGGPRGSGR

SEQ ID NO: 15964 - protein, 724 aa, Actinoplanes utahensis
MPLSRRSWLAAGTMTVVVAGLGVAGITEALAASSGTLVSSANGRCLDVTDGSTANGNQPQMWRCSGGPNQNWTLADNGQVRALGKCLDVANNATANGAVVHLWDCYDSVATQKWTLTASKDLVNLAANRCLDIKDGNLADGAKLQLWDCSGGAHQKWTFSGSGTTPPTTVPTDPANPDLGPNVTIFDPSMPASTIQSKLNAVFNGQVSNQFGNARHALLFKPGVYPVDANVGFFTQVAGLGLTPDQVTINGHVHAEADWWPDGSQNATQNFWRSAEGLSVSPADGLDRWAVSQAAPYRRMHVRGNLALSDGGWSSGGFIADSKIDGQIQSGTQQQFLTRNSAMGSWSGSNWNQVFVGSPGAPAQSFPSPPFTTVGSAPAIAEKPYLYVDSAGAYQVFVPAVRTNASGPTWANGTPAGTSLPIGGFYVVKSGDTAATINAALAAGRNLLVTPGVYHLNQTLNVTRAGTVVLGLGLATFVPDGGVDAMHVADVDAVRVAGLLFDAGTTNSAILLQVGPTGSTATHAANPTVLSDVFVRIGGAIAGKATVSVQINSNDVIGDHAWIWRADHGNSGTVGWTTNTARNGLVVNGNNVTFYGLFVEHYQQYQTIWNGNGGRTYFYQNEMPYDPPNQAAYLNGATRGWAAYKVADTVTSHEAWGLGSYCYFAVNPSVVNARAFEAPAVSGVKFHDMVTVSLGGTGTISHVINNTGAAANSGHQVTDLTSGP

SEQ ID NO: 15965 - protein, 164 aa, Actinoplanes utahensis
MRSLLRSFALAALVVPAAAGVMMTASPAQAAPAKAKAAEQALQADINRLINEQRVQHGCGELTENAALTQAARAHSAWMGQTGEFSHTGRGGSNFVARDRAAGYARPSAENIAWGYRTADDVVTAWMHSPGHRANILNCRSKTVGLGAVYAADGTPYYTEDFGY

SEQ ID NO: 15966 - protein, 288 aa, Actinoplanes utahensis
MPDDPGQPARHSRPAGPDRRRLRRQGHRRRRRGERPRDQRGELHRPPGVDQRPAGRPPGTRLTLIVAAVHDHSRRLVAGSLLLAGVLAAAGCSAHASAQSVPAPTPSGAAPTLAQAATRLGTETARFTVTLGAAERATGVIDPATGNWEMTGDGYVVRRIGPAVYVRLTAEPAHSMYPGQYADDLGRWVHTTVPTDAAPAFAEGFPWAAARTLAGQPGAAPGASGRFRLGGGTAELDVAGRFSRITLTDPAMTVSYADYGLPVRVTAPPADQVAEDHLFTVANLGPIF

SEQ ID NO: 15967 - protein, 459 aa, Actinoplanes utahensis
MRNRSNAPLVVYLCAAFTTLLDQASLTTALPALRGTLGAGPATLQWIIAGYSLTFGLALVPAGRLGDAHGRRRLFAGGVALFTMAAIVGGTATAPWVVAIARLAQGAGAGTVNPQVYGIIQDLYTGRARTRALGAYATVGGIAGVIGPPLGGLVLNAAGEHLGWRLILLFTVPFGLTTVPLAILLLPRGRAPQAARTTLDLPGLGLLAVTTLGLLLPFTLPAGSGPPRAVWALAAGAALLALIAWERRYARRGRTPVLIPDLLRRPGFSLGTLTAMFQFGASLATTLVLVLHLQDGLGWSPLRAALTTLPSALGFAVASAQSWRLVTRYGRPSVTAALTGAGPVDRGHHPGAAHPVRRRAGRRTGRHPTGHGRHRRAGRLAEPGAHPGRRARRGGRAGRGVPAGLAADLGHVRDRRGDRRAERPHRAPAVPGHDGRRGRDVRPRQSPACDAGNHRQISI

SEQ ID NO: 15968 - protein, 291 aa, Actinoplanes utahensis
MAHRQPHLALELGATAGPEHVAAAEAAGFALVTIDDTPGAAQPEAGVRAAYLARRTRRIALAPTLHATVTEPFHLATQLASLDHASLGRGAWVVGAAAGPAAYATVGLPLLDGAALRREIADVIDVARRLWDSWEDDAIIRDVPSGRFLDADRVHHVNFTGERFSVVGPLITPRPPQGQLVVLGADTLGVTDRLDIALIPFDTVDALSARAGQARTDGAPLVFADLDLAVAGDDPAGLIDRLGRVVDGVRLHLGDIDADLPRIAATLSRPPVTGPTLRDTLGLPRPVNQFA

SEQ ID NO: 15969 - protein, 417 aa, Actinoplanes utahensis
MLHLGVFFTGVGPQLLWTDPAFSSHTHIDSFIATARTLERGLFDAFFLGEGLRVRENRGRVHDLDVAGRPDAITQLAALAAETTRIGLVATQNTTYNFPADLARRLASLDAISGGRAGWNIVTTDNAWTGENFRYGGWLPHERRYERAAAFVETAKALWRGETVDRHDDLIDVTAGPTVPASPVLFQAGDSAGGRDLAARHAEVVFSANTDFDKAVDYATDLRRRLAGHGRPADAVRILPGASVVLGDTPAEAEEKARWIAREQVTGPRALAFLEQYWGKDLSGYDPEGPLPDIEPAEGELDPSRGTISIEHRTGKAERIAGWRRLAEDRGYSIRDLVIEVTPRHSTFVGTPGQIADRWARYDEARAVDGFNILPQLLPGTIEDIVDRLVPELQSRGIYRTEYTGTTLREHLELPPA

SEQ ID NO: 15970 - protein, 436 aa, Actinoplanes utahensis
MGSCSRGEREASLLKRKKMVTFGTVVSTLLLSALAVSPAEAHGHLAPAGAKDILDSSIDPNQDRLMDFKSWLIGLPELADSGYIESINDSSNLSTTLLWSGDETALQKSIAAEGKRRGITVTFERRKFSRAQLDQAAAKVMAQGRDGMGGFQWSAISTVNPKFDGIVVKGATGANIKGKSIPNALDSDAASALSRRIAALTDVPAMVEAGASVNLDGQRWSDYSPFNAGGLMVQGNDTCSTGFSVNVNGSPYVTTARHCVDHHYQTLSGSRSYGDGVRNSGDGAARQMSAKGSGRVFDGAWDNSAGYDKKVIGYGDVSIGDRICSSGAESGVHCGLRVEESDMISDNYPGGANFSAIYVFGDVFACKGDSGGPMLTPRNTSDVLAVGMVQKGDGRYELPAFSISERYMVLPCFRGGWITSMRTIVNTLPNASLVLG

SEQ ID NO: 15971 - protein, 276 aa, Actinoplanes utahensis
MVAAVLCALCYGVATALQARAAATGSMLGMLRRAPFLLGILLDLAGFGAQLLALRYRPLFVVQAAQAGNLAVTAVACVPLLGIRLNARQWSAVFAVCAGLALLGASSGAEGSTVVGTRTRLVLLAAALLLAAITPLATRLRAPAGPVVQGAVAGLGFGLTALAVRAVPSLQPAALLHDPAAYAAAICGVCAFASFAAGLQRGSVTAVAALAVIGETALPAAIGILLWHDRTRPGWAVPAVLGFVLAVAGALSLSSFAEPARQPAAPPAGPPVEHPV

SEQ ID NO: 15972 - protein, 227 aa, Actinoplanes utahensis
MRRTCRSCPPRYVPFHTGQAIHEDLNAFRPEWGCRRLAGMISDVPSLLTALAAGRHPKYLYFWGHTPARDGSVSATCLSQWSPEGCTVDGIRYATAEHYMMWSKAVLFGDTAAAERILAAGHPRDAKLLGGRVTPFDEPTWRARRTDIVTRGNLAKFGQHPDLAAFLLGTGDRVLVEASPTDRIWGIGLTRDDPRAADPARWRGLNLLGFALMTVRERLRAAAPAGG

SEQ ID NO: 15973 - protein, 264 aa, Actinoplanes utahensis
MGDRIDTSVAHPARRYDFLLGGKDNFEADRQSALEIERRHPTARLSALENRYFLHRAVRFMAGQGIRQFLDIGTGIPTSPNTHEIAQGVDPQARVVYVDNDPLVLVHARALLTGTPQGRTTYIEADLREPARILAAPDVLATLDLRHPVGLLLIAVLHFIRDDDDPRAILDTLIDALPPGSVVAVSHATPEYMPAEQVAALRAVMEKQWQDRTGDELRALFDRPDLEFTGPGVQSVAAWWPQDAPQPRPAVEDIASNGLVARKR

SEQ ID NO: 15974 - protein, 75 aa, Actinoplanes utahensis
MTVTLKPGQAANAVLQSTNVGFFDKDKCKPVDVRGIRVYPPDETTSIFVSLPGQACSVKGQGVGTIWAIAAGSKV

SEQ ID NO: 15975 - protein, 54 aa, Actinoplanes utahensis
MMRSAGRPGDYKVVMKRTMIVLLAAPLLLATGCSSTGSSTTTAGAAPATTTAAS

SEQ ID NO: 15976 - protein, 371 aa, Actinoplanes utahensis
MGASAAGITAAETLRRSGFTGTVTVIGEENHLPYDRPPLSKQILAAEWEPSRILLRTAEQLAALDLDLRRGVRAVGLADRTVLLDDGDTAGFDALIIATGVRPRTLPGAGAHAIRTLDDALALRGRLHHGVHLIVVGAGFLGAECAAVARGLGCAVTLLEPAPVPLAHAVGTEIGRVLAAVHTDRGVDLRTGVAVSAVTGRGVLLADGTHLEGDEVLVAIGSLPNTEWLAGSGLTIGDGVVCDAFCAAGPGVYAAGDVARWHHPLFGVDLRIEHRTNAGEQAMAAARNLLGAGRPFAPVPYFWSEQYDLKIHAYGHPRLHDRVEVTEGSLAQRRFVAVYHRGDRMVGALAVDMPPKAIRPYRQRLLAAGTI

SEQ ID NO: 15977 - protein, 401 aa, Actinoplanes utahensis
MTDTVPAYPFAHPAALDPSPEWEQLRNECPVARIRLVSGDEALLVTRYDDVKGLLADPRFTHSLARPDAAKISASDDGGVFNREESAMIASPDHPRWRRMMNRSFTVKRVTAMRPRIEQIAHRLIDEMVAAGQPGDLQSALGFPLPVFVICELLGVDPGYRDTFSHWSDAMLNLTRFDQAELTKAAVEFQEFMAQHVRDKRAEPGDDLLSELAAIVDSQDGRMTETELVLTAQGLLVAGHETTANMIGKMVAMLLADRPARWERLVADRGLINSAVEESLRFDANPGIGLPRYISEDIEIAGCPVKAGTVVMASMAAGNRDETAYEQAGEMRLDRSPNPHLSFGAGPHSCLGQALARTELQVTLAVLLDRLPTLELAVPPEELRRRTGLIVGGLEEVPVRW

SEQ ID NO: 15978 - protein, 119 aa, Actinoplanes utahensis
MLLGVVGLYLWQRLSPLVVEGVTVAVPQPAGDRCDVTVPVVATVRTNGRGGTIRYQWFRSDAASGAMLTERVGRGQRTVTLTLKWAFSGVGTAAETATVNIVEPTPVQAGTRVAYHCRG

SEQ ID NO: 15979 - protein, 457 aa, Actinoplanes utahensis
MRVRPGETEVVRRGVGGGLGGGQHRPGRGARRGEQAGQHEQHRFHGASSAGMRFPAAPYRRLWSMSRGWCRPSDAREQPLRRCPVDRGWSQWAARRGPIPALRRDCGASRMSGWQPTGYTPVRALGAGASGSVVLATHDATGTPVAIKHLTGQISDDAAFRAAFRQEARLLGEIDDPHVCRLYEYVESADGAAIVMELVNGVSLRQMLREHGPGTPEAALCVLKGSLSGLAAAHAHGVVHRDYKPENVLVTGDGRSKLADFGIAVPVGQGAATVVSGTPRYMAPEQWTGGAVTPACDIYAATATFFECLTGHPPYDGANLFALHDQHAHAPIPTGATPEPVHDLLRRGMAKQPADRPPHALAFLDLLERVAGAAYGPDWEDHGLRDLARRAALLAALWPFPDGSSGATSVATTTFGSSAVSPARRLRRGRRTTALAAGALVAAVLLGGAGYHFAVAS

SEQ ID NO: 15980 - protein, 380 aa, Actinoplanes utahensis
MTAFVESEERRELRGAVARLGRKYGEEYFYAAAREGRKTTELWQEAAALGYLGVSIPEQYGGGGGDIGDLAAVLEELATAGCPLLLMVVSPAIVGTVIAQFGTAEQQRRWLPGLATGAATYVFGITEPDAGSNTHQIATRARRDGDDWILSGTKTYISGVDEASYVLIVARVGKRPSLFMVPVGAPGFTYRRIDMGLVAPEDQFTLFLDEVRLPADALIGSEEAGFDQLFAGLNPERIMAASSATGMARWALRKAVGYAGDRAVWGVPIGTHQAISHPLAKLHIEIEAARLLTQKAAALHVAGELKAAGEAANMAKYAAGEAVCAAVDQAIQTHGGNGLATEYGLVQALATSRLTRLAPVSREMALNFVAQFSLGLPRSY

SEQ ID NO: 15981 - protein, 624 aa, Actinoplanes utahensis
MMIRRLLVANRGEIARRIFRTCRNLGIETVAVHREEPDLHVREADIAVAADFLDAEQIIDAARRAGADAIHPGYGFLSENADFARRTEAAGLIWIGPDPDAIAAMGDKIRAKKLVAAAGVPILGGDADTYPLLIKAAAGGGGRGMRIVTDPGTLRSELAAAAAEAQSAFGDGTVFTEPYLPRARHVEVQVLGDRHGRIWIVGDRDCSVQRRHQKIIEEAPAPLLPDDVRAALHRHARAAAEAVGYRSAGTVEFLVDGDRIFFLEMNTRLQVEHPVTEAVTGLDLVAQQIAIAEGHALPPAPPPITGHAVEVRLYAEDPAAGFAPQTGELRAFDFAAAGVRVDSGVEAGSRVGVRYDAMLAKIIAYGPDRPAALRLLADALRRGRLHGLTTNLPLLRAILADDDFAAGRLDTALLDRKLAAWTGVGQDHAVRKAALAAAVGSAVRTAGSANVQARIPAAWRNVPSAARVRTYRCLDREYAVTYTARCGRIESSWLPGVGVVSVDGDRVVLDDHGVRETYRVTPHAGGADVHGPAGPYDLLTVPVFGDPAATLAAGSLLASMPGLVVAVHVGEGDRVAAGAPVVVLEAMKMQQTLTAPADGVVTALSAAVGRQVAAGDVLAVIDGS

SEQ ID NO: 15982 - protein, 524 aa, Actinoplanes utahensis
MTLPPSYDLNRTAMLERVADLERQHAVAVAGGGPKAVERHHRRGKLTARERIELLLDEDSAFLELSTLAGWGTDVTVGGSVVTGIGVVEGVECMIVANDPTVRGGSSNPVTVKKSFRAAQIAAENRLPTINLVESGGADLPTQKDIFIPGGRHFRGLTEASADRRPTIALVFGNATAGGAYVPGMSDYVVMVAGGAKVFLGGPPLVKMATGEESDDESLGGAQMHARTSGLADFLAVDETDAIRIGRQIVRRLNWRKLGPPPRAGYAEPVLDAEELLGLIPSDLKVPFDPREVVWRIVDGSEFDEFKPLYGTSLVTGWARLHGHPIGILANAQGVLFSAEAQKAAQFIQLANQADTPLLFLHNTTGYMVGKEYEQGGIIKHGAQMINAVSNSRVPHLSVVMGASYGAGNYGMSGRAYDPRFMFSWVGAKSAVMGPAQLAGVVSIVSRQAAAAAGRPFDEEADARTRAAIEAQIERESLAYFTSGMLYDDGVIDPRDTRTVLGICLSVIHNAPVQGARGYGVFRL

SEQ ID NO: 15983 - protein, 630 aa, Actinoplanes utahensis
MRTIRVGNCSGFYGDRLTAMREMLEGGPLDYLTGDYLAELTMLILGRDRQKNPDTGYAKTFLRQVADCLSLARARHVRIVANAGGVNPGALAGAIRALDPTVRVAHVAGDDLLTGAFPGALTANAYLGAFGIAEALRSGADIVVTGRVTDASLTLGPAIAAFGWRRDEYDKLAAGIVAGHILECGTQATGGNFSGFATIDTSRPLGFPIAEIDDDGAVVITKHPGTGGAVTEDTVTAQLVYEIDSPRYLNPDVTARLDTIRLAAPEKDRVAICGVRGEAPPATTKIGITRLGGYRNTVSFVLTGLDIEAKAAWVREQFESGLGRRPETLVWDLIRTDRPDPGTQAEGAAVLHCHGKDADPDVVGRPFSGAAIELALASYPGFHVTGPPSGATPYGVFEAAYLPQGEVPHVVVLPDGVRVEVAAPGWERAGVSAGSGRPGRVVSADGVHAGPPASERGDVVHTGGLSTGDPHDRGVGDDTGSGMVPLGGRAVVDGGQRSHPTTTEPPNHPAPDGYRHHTRAPLGHLLHARSGDKAGTANLGIWIPAAHPHRLAAFRWLTRWLTADRLRTLLPESTPFPISLHPLPNLCALNIVIAGLLGDGVAASTRPDPQAKALGEWLRSRLADIPTELL

SEQ ID NO: 15984 - protein, 210 aa, Actinoplanes utahensis
MGRSRTNPAPTAPVTARGRRTRDALLAAGRELLETRGWPAFTPEQVAAAAGVSYGTFYTYFESKDDLLGAIVRAVAEEMFTDSLVAPDTADDPYVRIVASNRGYLRAWRNASRVLRLVEQGAAADDTLRQLLLEVRERYVHRGAEGLRRLQEAGLARTDLDPRLTAIVLGAMVEQMAHVIYSLREPLDEEVVVSHMSKLWAAAIGLRGHP

SEQ ID NO: 15985 - protein, 245 aa, Actinoplanes utahensis
MDVEEITSETVRPVARAVLGQRWTDLAFLHWAVDPDRVAPLLPAGTVPDVIGGVTYAGVIGFRMERIGFLGSPGVPYLGTFCETNVRLYSVDAQGRRAVVFRSLEAERLIPVLVARASLQLPYMWARMRIVRDGDELAYVSRRRWPGPRPATNRMRIRVGAPIAEPSPLEDFLTARWGLHTRAWGRTRHLANDHPRWPLHRAELLDLDDSLLAAAGLPGIDTPPVSVLYSPGVPVVFGPTGRVSR

SEQ ID NO: 15986 - protein, 35 aa, Actinoplanes utahensis
MTLSSRGDGLSLDELTKVAAQVRVDPAGLDRLGHP

SEQ ID NO: 15987 - protein, 46 aa, Actinoplanes utahensis
MSPFDGRGSVFLPSPSSCPGGATLTVAGHPARHPQRTDAPGKNRPT

SEQ ID NO: 15988 - protein, 323 aa, Actinoplanes utahensis
MESITKNRQSPDVLRAMVERAYGRAEVPAGDDWYVELSHGWFNVAYRIRLRSGHRTVLKIAPPPGVEVMTYERGAMATELAALRLIREHTDVPVPEVEFVDRSHELCDADYFFMAFIDGDNLGMLRGQQSPRERAAYNLSLGEINRRLNAIRGERFGPLDGSGDPSWRVVFTAMIEGVLRDGERRDVPLGFGYDEVRAVIAAHAGSLDEVTEPRFVEWDMWDNNVMVRDGRVVAIIDHERAFFGDPLIEAGFTGSEVPAYGDSSAFIQGYGRGPATEAERIRRRLYCLYLALIMTIETAYRNFPGTGNYDWASERLKETMALF

SEQ ID NO: 15989 - protein, 52 aa, Actinoplanes utahensis
MIAGGWRTSSGAASGLRPRDLGEEVSALRPGVLPAFVRRPDGWQAVHDLHEG

SEQ ID NO: 15990 - protein, 64 aa, Actinoplanes utahensis
MALSGDGRTLATGSHDHTAMLWDLTDFNDLRDRASERACAITGGLSHEDWALYVPELAYEPTCP

SEQ ID NO: 15991 - protein, 473 aa, Actinoplanes utahensis
MRYDAFISYSHAADGALAPAVQRGLQRLARRWHRPRALEVFRDQTGLAVSHALWSSIKVALDQSEFFVLLASPEAAASPWVNQEIEHWLSRHSVDRLLPVVTSGEWVWDADAGDVDLERSTAVPPALRGVFGEEPRHLDLRWARAEHELDLRHGRFRDAIAELAAGMHGMSKEDLDGEDVIRHRQMLRMRRGALAVVCALLLLVAGTAVAWRNARGEVTATNVALQRQRAATAAEQHRTEEAADQARSQQQIVEAEQQRAQKAAEEARGQQAVAEAEQQRALRAAGEARRQEGIAAAEQRRAQKAAAEARRQRGVADAEKAKANRAAAEAERQRKIAADEQRKAHEAAAEAERQREEAVKQQRIAIGRRLLGQAGEARDRDPRTAIQLGIAARHIYPGPQSQAGLVETLVRTHYAGTVTGHTAVVSAVALSGDGRTLVTDGLDGTVMVWDPTDRAAPRRLAQLTSSTAPVYTS

SEQ ID NO: 15992 - protein, 730 aa, Actinoplanes utahensis
MSDIQDQKASGCPVAHDSATGHGGSESENPGIPSPQARTGGRPRGNRDWWPNQLDLSVLHAHSSKSNPLGEAFSYAAEFAKLDVEALKRDITEVLTTSQDWWPADFGHYGGLMIRLSWHAAGTYRIQDGRGGAGDGGQRFAPLNSWPDNANLDKARRLLWPVKQKYGQQISWADLLVLAGNVALESMGFQTFGFGFGRVDTWEPEEIFWGPEDAWLGDERYVSDKTMSEGVGATEMGLIYVNPEGPRGNADPAQAAHFIRETFARMAMNDEETVALIAGGHTFGKTHGAAVAADHVGPEPEGAPLEAQGLGWLSTHGSGRAGDTITSGLEVTWTDKPTQWSNRFFEILFGYEWELTTSPGGAKQWVAKDAEAIIPDAHDPAKKHKPTMLTTDLSLRVDPAYEKISRRFLEHPDEFALAFAKAWYKLLHRDMGPVSRFLGPWVPEAQLWQDPVPAVEHPLPGDAEIAQLKATILESGLSTADLVGVAWASAATFRSTDKRGGANGARLRLEPQRSWAVNQPVLPVLARLEEIQRSSTVKISLADLIVLAGVAGVEKAARDAGVEVSVPFKPGRTDATQEQTDVESFAVLEPRADGFRNYLRPGEKLQPEVLLVERAYMLNLTAPEMTVLLGGLRGIGVGATGSGRLTNDFFVDLLAPGTRWTASESEEHVYEVRDASTGDLLRTATAVDLVFGSNSQLRALAEVYASADARDRLVRDFVAAWTKVMENDLF

SEQ ID NO: 15993 - protein, 341 aa, Actinoplanes utahensis
MLSCMTPAAIPTGTDPRYVVIGAGAVGASIAAELHRAGADTLLVARGAQLAALRADGLRYVRPDGVHQVRIPVVAGPEEVELGEHDVLVLATKSQDTATAVRDWAWRPVKRADGATGLSATDLPLVTLQNGLDNERAALRSFARVVGGVIGIPATFVVPGEVVNHAADAPAVLFLGSYPAPASDPLAERIGAGLRRGGFRVHVVADIVAYKAGKLLGNMANTLDALYPESPLRDAALRTLQAEATAVLAAAGITPAALDLHEFRLGEIPSHPRVGASTRQSLARATPPETDYLDGEIVLRGRLHGIPTPAAAAIQARLHRALADGTPPGSLTDDDLARTLP

SEQ ID NO: 15994 - protein, 375 aa, Actinoplanes utahensis
MPWCAGWPGVSPSGTPTRWVWRSRRTEGWTPILTSRTVPTRLPRRSGFSWYRTIRLNAAGRLLDDAAEPVPAARVREHLASRLRLPRSVTDIFVFVHGWRTPHRTAQSSFARFFGAVWNGRERWASLPGAAGPFVPWFIGVQWPSSSAPTPGGYQRIRERAHAVSTGGHAAFVLGQLLGYLDEQRDRPRRGADRLTNAAGQYVHCVGHSFGGRFLGEAIRRAADRPAGTLGWDHRSRHPFGVDTYLAFQMAAPPDIFDGRLAGILTDGVVHGRIVLTYSRLDHANAIWHRAMERRPGIGAVGATAPAGLVSTIPLHRPGDPYHRADFATPIVNVDASPVFTRPRLSVTGAHSDYWHAHSIHLLLSLAALARPTGG

SEQ ID NO: 15995 - protein, 890 aa, Actinoplanes utahensis
MPAQLPPGNSTFRGRAVELSTLRERHDRWRERQRTSQTEAPVLIFLHGMAGIGKTAVAQSLAHALKEDYPDGQLYANLGVAGTSRSPAQVLHSFLPALGWDVERIPTSTAERAWLFRTLTRDKRMLIVLDAARDQAQLRDLMPSESRCAVIVTSRRDMSPAFGARSLQLRPLSTDDGIDLLAAVLGYGVPFDLGAATAIVYACGGHPLALRAAADLAAQRRMSLPALADELREPGGLRAVLRAPSRDLHDRLSGQYKALGPDHQKAFRLLSFVGSDTFVPWVLRPASGVALPEAESLIADLASAQLVLAAGRDEVTAIDRYALPPIARQLAVSLAEPGDDPDGARRRIDEAYLEAAERVIRELDAGFAAARPASPVRWLPADARFAHRVAGRGQAKVWVREEYGNLLRVIRLAAERGDHALITRIASWLGGCAPRGVPAAEVLDGFRIAVDSAQHLGAAARADVLLARGAYRTAVERYTAAFEDFAEAQSLCRTGSLASRRVLLERRCGEAHLRAGEFTAAAGRFARAQELAARLPAGAAMLPLLRTLRRLADPDAGPPEPVEPVDPAGPGQPDDELAYWSALAGCDRAVAGDGWDTAERILAAAAADYHDDLRRAATIAYWQARLHLARHHRAPGSGHLRPALRAAHRSLHDHLLLGDPAGQVRTRCVLVSAYLAAGRTDLADRQLQEARRARAGVDPWLTRPGNPLDALLRRARAEAARHAGRDEEAVHELRRAALVLAANGDRRAVAEIAGLIGDDPAVLWRDAEAEAGSAGAVRAYLDHGPPITVGQAVTLRVEISAAHLRRYRDVVSGTSLTVLVCADGADVVPMGAAVDLRDLRDDVRLVHELRPRIAGPFSVKVQLYAPGDGVLLQEFEAGLAPVARAEREAA

SEQ ID NO: 15996 - protein, 812 aa, Actinoplanes utahensis
MPTSRTEGDRPSIARPDSGILTSRQRPSARSGGVVHREPGTVRLWIRRLGAVTLVVMPVAFARIVSASAHSDGLFAWLALFAGYLVGVLGIGLAVVVSRQDGPRPPVPLVPRELPAVPPLLLGRADRVGEAVAYLSAATGPAVRTVVIAGAPGIGKTAVALFTAHRVAARYPDGQLFATLDARGRDPDEMVRRTLIRFLLALGHPAERAAGLDVCRQEFQRMSAGKRLLVVLDDVHGLDPQPLIPAGAGSAVLLTSPQVRPGRAPHLLLPLEPLADRDAVALLAQIVGEQRVRDSLPAATALARACAGLPLALQIAGQALVARPSADMSVVLSRADVASGDSRPTERGRDPRSVEPGHDPRRWALNVSYELLSRGDRDAVLSLGRLSRRFEPWMLAAETNLDEDQARSLADRLSATQFVERWTADAAGVPVYETVEHVQDFARLRAGGDRPAPPHPRPRTRDPLDEQRIHTYDLLDKGSLVAADVNVREVLDRARQAGDQPGVGKALAALAELRAELGGTDEVVDLAEQAWQHQDPGIRARVYRVMGHIQRRVRQLDVAERNLSRALRHAGQAGDEPEQIRVLTELALVHRLGGRAAQALEHTGRAMALAEGRRDGGIRYRSRILLAEGMTLIKLSRYAEAEQRFADARAAADRAGYRLWRQWVDYRDAQLHVRSGDAVRAQDLAIAALAGFTGIRHRYGTGHCRLLLGRIHADAGQYAAARTVIEDALETFRNCGDRFIEGHAAAELASVHLREGSLAAAADALRRAKQLKTGQRYWQTSLRLTGARLRRMAGGGAPRRVEPIAPSSPVGW

SEQ ID NO: 15997 - protein, 1031 aa, Actinoplanes utahensis
MHPVPELREAAAGADRRVGSVRATSPPTDCPDTVTTAALSTDLVRSLNQAGVTDVLTDPAHRSAYASDASLYRVVPRAIVRPRHDEDVAATLRVCRERGVPITARGAGTSVAGNAIGPGVILDFSRHLNRVLEVDGDGRWARVQAGTVQATLQAAAKPFGLRFGPDPSTHTRCTIGGMIGNNSCGSRTLGYGRTSDNVLALKALTIDGEQLVTGPVTTGADKTVAALKDLIGAHLAVGRTEFGTFGRQVSGYAVEHLLPENGFNLTEFLVGSEGTLAVVTEATVRLVADPVHRTLVVLGYPDFGTAGDVIPAILEFKPTACEGLDHRICDVVRSRRGPDAVPPLPGGAAWLMVEIAGDDLDEVRERVAGLVKAAQAVDSLIVEDTAQAAPLWKIREDGAGLAGRAPGGLPAHAGWEDAAVPPARIGAYLRDFDALTARHGLHAMPYGHLGDGCVHVRLDFPLDKPGGPGRFRAFLEDAADLVVSYGGSLSGEHGDGRARSELLSRMYSPAALDLFRRIKHTFDPDNLLNPGNLVDPDPVDANIRVSQARPVTTKLALAYHADGGDFNQAVHRCTGVGKCRVDTTVLGGVMCPSFLATRNEKDSTRGRARVLQEMLDGDLAPDWRAEAVHDALDLCLSCKGCASDCPTGIDMAAYKSEVLHQSYRGRARPRSHYSLGWLPRWSRLASRVPALANLMTNLPGIRRLALYVAGVDARRSIPTFADRTFRSSFRGVQTGKPVILFVDSFTDHFAPDIARAAVDLLTDAGYAPRVTSRTACCGLTWITTGQLDAARRILGATVHELHQAVKQGIPIVGLEPSCTGVLRQDAVELVDTEAAKEVAAATRTVAELLAATPGWTPPSLAGVRVIAQPHCHHHAVMGWEADAKLLKRAGATVKRLGGCCGLAGNFGVERGHYEVSVAVAEQQLLPALAAAEEGDIFLADGFSCRTQADDLAKVSGLHLVQLLADALPANRSAATTGDSGTGLAGAGDSAPGAPAPGASAPGASASGASAPGASASGASAPGHEARLGDEE

SEQ ID NO: 15998 - protein, 134 aa, Actinoplanes utahensis
MTGDIRSFEGADYEPVAAVWAAAGAGVLSRDELTRKLTRDPDLFLVATDGPELTGAVLGTWDGRRGWIFRLAVHPDHRRRGIATALVRELESRFRALDCPRINLLVLPDNEAGLRFWQDLGYLPAPDVLCTKPL

SEQ ID NO: 15999 - protein, 341 aa, Actinoplanes utahensis
MVEWGMLLAPLLVAAVNAAPVCRIADKRMDELSGLVTTADGYVVVNDGSDEASHRRIFYLRKDCSVARAVSYPSRPRDTEDLQLGRDGILWVADIGDNGRSRDTIALWRLTPGSSKPQLLRMSYPDGAHDAEALLITAEGSPIVVTKEPGAAGIYVPDGGLRATGTTRLKRAGDVSVPFTSTSNPFSLAGRLLITGAATSPDGSRVVLRTYADAFEYDVPGGDVVKALVSGTPRQIPLPDEPQGESVAYTTDGTALLTVSEGAKPPILRHPLPDTPATPRSPASSTADQAAPSAAVPPAAAEAVRATPKSSSSRLPLVLLLIAATALCLAAAIAAARRRKR

SEQ ID NO: 16000 - protein, 748 aa, Actinoplanes utahensis
MEARSPAEVIKDAVTAVTSEKKPDVPGAPGSGTPTVEEPATPREPLPPKPEQGQPDTRTPTGAPTGAPPTAYGQQGPYLTTAQGARLRDTDHSLKAGPRGPILLQDHHFREKITHFDHERIPERVVHARGAGAHGVFTSYGTAAALTQAGFLKEKGKQTDVFVRFSTVLGSRGSADTVRDTRGFATKFYTDEGTFDLVGNNMPVFFIQDAIKFPDIVHAAKWHPDREIPQAQSAHDTFWDFVSLHTEAQHHTMWNMSDRGIPRSYRTMEGFGVHTFRLVNDAGETVLVKFHWKPKLGVHSLVWEEAQITNGVDPDFHRRDLYDSIEAGAYPEWELGLQVFPDNPEETFAGIDLLDPTKIVPEELAPVQPVGKLVLNRTPTNFHAEVEQVAFHLGNLVPGIDVTNDPLLQGRLFSYLDTQLTRLAGPNFHQIPINAPHAPVNDMLRDGFHQHAVHAGVAPYRPNSLDGGNPFTTTEGSFVDVPVVVTEAPKIRDLPVSFKDHYTQVRLFWQSMTPVEREHIIRAYTFELGKCYHQAIKERQLQCLANIDPVLCEQVALGLGLPAPAPSIDLPEVTPSAALSQIGQQWPADGRIVGIVVDETGGDAAVAEIREAIAAAGMVPLIIAPHGGKVGGLTVQRTFATARSIEYDAVLVAAAPVPAPDAVPARDEKAGAPRTAAVDPRVNMLVDEAWRHAKAIGGWGTGADLLRRTGLADTPGVVVGDSATEVLTALQQLMANHRVWERFPATVA

SEQ ID NO: 16001 - protein, 772 aa, Actinoplanes utahensis
MADTPHEPRQTVRPSIGPARTASRGRVTTTIRPCSWPTIGSVRTSVAVPVLSYPSSIKVTVTRARRNECLMPTEPEIAPVVDAAHAEPFDTAADYRAAIERIRAAAAAYYAGTDLAMDDATYDALLARVTATEAARPGWTVAESPSDTVGAGGGVTGDVQHSTPMLSLANVFDPDELLAWAARLDRVLGRPAAGYTVEPKIDGMAIAARYTDGRLVQVATRGDGRAGEDVTAQARTVAGLPAELTRPVTVEVRGEVFMTDEDFTRANELRTGHGGAPFANPRNAAAGTLRAQDRAYVAPLSFLAYAVHDLPGGEGLTHSAAMAAIAELGVATTGGSAAGMAVCATADELVAAISRLGALRDKLGFDIDGVVVKADSPADRDAAGSSSRAPRWAIAYKFPADTRTSRLTAIEVQVGRTGLITPVAVIEPVQVGGVVVTSATLHNFGDLVRRDVRVGDTVFVRRAGEVIPEITGAKLDERPEGAEPFAAPEHCPRCGGDIDRSQKRWRCVQGRACGATESLAYFAARDSMDIEGLGDKVIRALVTAGLVTDPADLYDLDADTLARLERLGRTSAAKLVANIQASKQQPLSRVLTGLGVRMTGRSMSRRLARHFGTMEALCAATVDQLQEVAAVGPERAATIAAELADLAPVIAKLTERGITMSEPGVTPYHERVVATAETGLPLQKEDGTPMTVVVTGSVPGLTRNEGNEAVERLGGKSSGSVSKRTDLVVVGDGAGSKAAKAEELGVRIMASDRFAALLAAHDAGEAPALDDY

SEQ ID NO: 16002 - protein, 290 aa, Actinoplanes utahensis
MGPGEPADVVVTLAAAPASPSPTPSPSASPSAVPSASPTSSPSASPTASPSASPSVAPPPAGPPSGVTAQAGISSIVVSWNPPADTTGVTSYRATASPGPGSCSSSGTSCVMGAAAGTSYTVTVTAVGPGGESAASGSSNGVTPSAPEVPATVPTTDKTLTTPAGTDNTVAPGGTVTITGEGYAPFSTVTVIIYSSPLNLGTATADAQGRISVTVTIPSGLPIGDHSIVASGVDKSGNALVRRLDVKAAAKTATETPTLPTTGPAVIWLLITGAAMILTGVTARIIAARR

SEQ ID NO: 16003 - protein, 204 aa, Actinoplanes utahensis
MTETTRPYIPAMGRHGMLFLYDPFTRVAGLRRVHAELLDRAGARPGQRVLEIGCGPGDLLLALARRTPQSDLTGIDPDPAALRKARRKAARRGVEVRFEQAYADCLPLPDASVDRVLSCYMLHHLEPEAQSAAFREVRRVLRPGGELHLVDADGAAHGLSLRLAGQTPERIVDLMRSAGLTDPAHTGRGAGRVIGRYAFYRANA

SEQ ID NO: 16004 - protein, 320 aa, Actinoplanes utahensis
MQASVGDIVGSVAGIGHSSVPHSQAARMARTTAGGVPVAVFERAPGVPAVAVSRLPDVPLTAAVLPGRRTHTHDFLVLFYAARAAGTVVIDDRNWSVADGDLFVIAPGQVLSFPEPADGMVADGWVVFFPADVIRSGACSSWRAHPLLFPFAHGARRAQRLHLPPADRDGWVAGLRALDAELRARASGFAEAALAHLTLLLVAVARRCTGVAEEPLIAAVLDVVERRFAEPISLADVAAELSLTPGHLTTVVRRRTGRTVQQWLGERRMQEARLLLTDTDLTVAAIAHRVGYPDVSYFIRRFRTAHGLTPCRWRTYPDPP

SEQ ID NO: 16005 - protein, 366 aa, Actinoplanes utahensis
MLGEEEAQAAADAVRSGWVAQGPRVARFEKEFAATVGAAHGVAVSSCTTGLHLALVLLDLRPGDEVIVPSLSFIATANAVRYVGATPIFADVDLATGNLTVETIDAVRTDRTRAVIAVHQGGVPFDTVALRKAAEAWGVALVEDAACAAGSTAYGAPAGTGAAVAAWSFHPRKVLTTGEGGMVTVDDPDVAARLRRLREHGMNVSAADRHSSSQPVLEAYLETAYNYRMTDIQAAVGLVQLGRLAGLVAQRRSLAARYHELLADIDGLVPVRDPAHGQTNYQSFWVLLDPPYRTGRDEVLAELARRGVSARRGIMAAHLEPAYADVTPGPLPVTERITRDSLILPLHHRVTDEDQQHIVGVLRDLA

SEQ ID NO: 16006 - protein, 321 aa, Actinoplanes utahensis
MTAVSIEGARALVTGGAGTIGSHVVDELVRGGAAEIVVLDNFVRGRRENLAWAIENGPVTLVEGDIRDVDLVRSVTAGKDLVFHLAAIRITQCAEEPRLANEVLVDGTFNVVEAAAEAGVKKVIASSSASVYGLAEQFPTTERHHPYNNDTFYGAAKAFNEATLRSFKAMKDLDYVALRYFNVYGPRMDIHGLYTEVLIRWMERIESGTPPLILGDGLQTMDFVHVADIARANILAAQADVTDDVFNVASGAETSLKELAAALSAVMKSDLQPEHGPARAVNGVTRRLAETQRAYDVIGFRAEIGLHEGLQQLVDWWRSSQ

SEQ ID NO: 16007 - protein, 352 aa, Actinoplanes utahensis
MNASEPIGIAVIGAGYWGPNLVRNFQASPQFRLHWLCDLDTDRARRVLGGYSTVRVTADLEEILADPAVQAVAIATPAGTHLKVALSALRAGKHVLVEKPLAATYAEGRQLVEEADERGLTLMCDHTYCYTPAVLRIRELLHAGELGELHFLDSVRINLGLVQRDIDVLWDLAPHDLSILDFVLPEGVTPVAVAAHGADGIGAGRACVAYLTLQLSNGAIAHIHVNWLSPVKIRTAIFGGSKRTLVWDDLNPSQRLAIYDRGVDVASPDELGDEQRRDILISYRSGDMVAPALTEREALRTMVDEYARAITTKTPALTDGRSGLRVLQLLQAASRSLTEGGTMITIDEGHMA

SEQ ID NO: 16008 - protein, 273 aa, Actinoplanes utahensis
MSGQQDSSNPWQAIDPLRSDARSLSDNRAPGGQADPFGRSGSPQRSHRRPASPSRHRFGRPSATLSATLRERRFMTDVTVAATADVDPRAEIGEGTRIWHLAQIREQATLGRNCNIGRGAYVGPGVSIGDNVKLQNHALVYEPAVLGDGVFVGPAAVLTNDEYPRSVTPDGRLKDGHDWTAVGVTIGTGAAIGARAVCVAPVTVGRWALVAAGAVVTKDVPDFALVVGVPARRIGWVGRAGKPLTAKGDGIWVCPATGAQFTETDGILTENEI

SEQ ID NO: 16009 - protein, 613 aa, Actinoplanes utahensis
MSVFAEAAALFAGPMWTIGWPHDGKSSVRSFLAVSGALAPVAPAPVLACLSGDPVVTRTSTGWVATGGADHGDRIDQDSGAFTVRLGKAARTRTGDVSTEALGVLLRDGVKADGPLLAALVPPFAAAHSEGAAAPVIAATDWLGFRQLFWWQGRGVAAVSTSALALRALAEADLDRPALAVQSLVGWQVGLRTVFAGVHKVPAGCLAVLHDGRILIHRYVEESLAVDGPSPSLEEAAVEQAAIMTAFHQAYLRDHPRSVLQLTGGQDTRVLLAAIPAGLRAGLPALTLDVHGGTDSRFAGRLAAMTGMKLHVHWMDEGPAVTPAEAFALAVRAARELDCMASPLALAPLLRAETQLEQGHRLSGLGGETCRGFYYFGQPGGATTGPRLIEKLATWRLYANEAVQSEALAPDFAASARADALELITASFDGYPTDWLAATDHFYLYQRMQRWSGAHGSVAAANRHFVNPMFDRRFIQLAHAVRPEEKRHGLLTGRLISLLDPALAAVPLDSGLIPNRLGRPGLAARTAAYRVTAQKAARKIRQKVRGQGRPQLGAGEMAALVVEHWRSEPDSVAPLRDTGLVRDAWLGEVLAGRATPAPATVAFLVNLLAIGEK

SEQ ID NO: 16010 - protein, 417 aa, Actinoplanes utahensis
MRAPIWTRRSVDEAFSAPGNSFGFLRLLFAFAVLVSHSLPLGYGREDPGGGLTHGQTVLGEIGILGFFTISGFLITRSAGRVPLPRYLWHRGLRILPGLWVCLIVTALVVAPVVALIEHGSVAGVFAEPGGPFGYVFHNLAVAIRQYGISGLLRDTPYGRLTGESVFDGSLWSLMYEVFCYFMIAGLALTGLLKRARWVVAALAGGLFAVIVHDFLTAPRIPGPQGVHGPFLGIGGIDTYSLVYLTYVFLLGALFELYRSSIVLNELGAIVAAVILLGTTQCGGFDVLGYPAFAYLTLWLAIALPAPFRRIGVRQDYSYGFYIYAFPVQQLLALLGVPAWGLLPYILLATAGTLVFAIPSWHLVERPAMALKHWSPRQRTTAGDQASGTNTAGAPLPLAGTVQTSLADGPVPERGRP

SEQ ID NO: 16011 - protein, 405 aa, Actinoplanes utahensis
MYLSLRDRPAEDPAAGPKVRVATTVVLLGVVSLLTDVSSEMVTAVLPLYMTAELGLSLLAYGVVDGLYQGVSALVRIFGGYLNDRTNRPKWVAVFGYGISALSRIALVPAHTFAAITGVITADRLGKGFRTAPRDALIADSSDPAVLGRAFGVHRTLDTVGAALGPLVAFGLLLLVPGGYSSVFVASFAFGLLGVTVLVLFVPDRRTGGAGLPARRLVTELLSPRLRRPLLAAGLLGLCTVSDGFLYLSLQHSGEFAARWFPLMYVGTNVVYLTLAIPLGRLSDRVGRARVFLAGHAVLLLTYLVAGRSGGGLVATLVALGLLGAYYAATDGVLPALISKRVPAEARGSGIAAAQTVVVLARFAVSLAFAALWESIGPRDALVIAAGFLVVGIGAAGWLLKGIDR

SEQ ID NO: 16012 - protein, 369 aa, Actinoplanes utahensis
MIPLVDLQAAHAEVAEEVDAGFKRVLATTGFVGGPEVAAFEREFADFSGAAHCVGVANGTDAVELALRAAGVGPGDEVVVPANTFVGTAEPVARIGARVVLADMDPATYLVDVDAMLAAIGPKTRAVVPVHLYGQLADAARLRTELAGSGVAVVEDAAQSQGALRHGRGAGADGLAATSFYPGKNLGAYGDAGAVLTPDHEQADLVRTLGSHGGLQKYVHDVVGVNSRLDALQAVVLRAKLTRLAAWSAARRAAAARYHELLAGVDVVLPQTLAGNEHVWHLYVVRIPGGPRRRDTVLGRLHEAGIGAGIHYPYPLHLTPAFADPRYPAGSFPHAEKAAGEILSLPLYPQITTEQQEATVRALATALKD

SEQ ID NO: 16013 - protein, 311 aa, Actinoplanes utahensis
MSTALAPARTGGDERLTGFAGEPLAHRRYRRMRFIRRFEETLLQLFEEGALNGTTHACIGQEADAVAVTEHLAAGDHIFSNHRCHGHYLAHSGDALGLLAEIMGKDAGVCRGMGGSQHICAPGFKSNGVQGGIVPNAAGIALAHQLAGSDAVSVVFIGDGTLGEGVVYETLNMAALWKLPLLVVCEDNRWAQSTPIAANLAGDMAARFAAFGVPVREVDSTDVEELSAIAGEEVGAVRSGTGPRVLLIHTYRLCHHSKSDDERPADEIAEHWLVEPLVVHGRRLDDADRARIDDEVETALDEVVATARALP

SEQ ID NO: 16014 - protein, 336 aa, Actinoplanes utahensis
MIFAKELGDTLRGALGDDERVVLLGEDIADPYGGAFKVTRGLSTAFPQRVRTTPISEGAIAGISAGLALAGYRPIAEVMFGDFLTLMFDQVVNHIAKYQAMYAGQATCPVIVRAATGGHRGYGPTHSQSLEKHFLGVPHLRVVAASLYHDPRVVFADFLSRDEPVLYVEHKLLYPQHLTLPAGGMVGDLIATADASPGMLPTIRLSAVPVQDCTVSVLAYGYQAMLAARVIERLAIEEEIFAELVVPAQIAPMDWAPVERSAAVTGSLVTVEEGADGWSWGSEAAAVMSRRLFGRLRRPVDVVASAPTVIPSSKVKEAEVLVGAARIEAAVRAAAR

SEQ ID NO: 16015 - protein, 368 aa, Actinoplanes utahensis
MNPVLVPTNDVNSEHGILVMWFAEDGAEVEKDELLAEVETSKAVLEVLAPVAGVLLHTAAKGAEVPLSQPIAQLFGSAAERDAHLAALAAAPATAAPAGPRATVKAVQRAAELGVDLAALGLDRLITVKDVEACAAPAVPPALLEPLAGAPGRQRILIVGAALGATQVLDILAGSRTQQAVAIVDDDASRWGASVHGVPVVGGSDRLGALFAEGAYDAAIIAIGRSPAVRARLRAACAAAGVPLANAIDPTAKIATDVSLGQGNIICAFCHIATGVRVGDNNFFSAYNSFDHHSVIGDDNASGPSVVTSGKVTIGSRIRFGTGIFIEPDVTVGDDAAIASGAVIVSSVPAEHVVKTKIVTTTVVPLRR

SEQ ID NO: 16016 - protein, 445 aa, Actinoplanes utahensis
MSLRTRISAALLAATLTGAGWAGTPLPADAAAGGTSRGVTIPDFYTPPATLPAADGALVRTEPLPLALSLPGITGPLPGTATRIMYKSTDSTGHPVAITGAYVEPSAAWNGPGPRPLVVLAPGTMGQGDQCSTSLALQRGLIIGTEDNQFTVSIGYEVLAMYRMLAKGIAVVQTDYAGLGTTDRLHTYVNRVDEGHAVLDAARAARALPATSLSARSLIGLYGYSQGGGAVASAAELQSSYAPDVQLTATYSGAPPANLAAVTAAIDGSELVGALGWSINGFVQSDPELRPLLDRYLSDSGRAVLKNLSTMCVGDAILGYATKRSTSWTTGGQSLADIVAAEPVLKAFLAEQLIGTRKPAGAVRIATGVSDNLVPHGQARTMAANWCSRGGNVAYAPVVLAPTISPLINHFGPLLVDQGPAVDWLALRLAGVPSIPTCAILPIQP

SEQ ID NO: 16017 - protein, 67 aa, Actinoplanes utahensis
MNPFEDEHGTYLVLINDEGQYSLWPEFADIPAGWTIAKAAASRQDCVDYVNEHWTDMRPKSLIEAMG

SEQ ID NO: 16018 - protein, 2088 aa, Actinoplanes utahensis
MTIPLTAAQRGIWYARQLASDSRMHTIGEYLDITGPIRTDVFEAALRRTVDEADCLTVRFTATPDGEVHQQTGAAAPWRLTVDDLSDEADPFEAAMRWMRTDLDRPFEPEAGRVFRYALLRLSPGRHLWWSSYHHLVLDGFGMGLITRRVAEVYTALHAGTAVPACPFGRLSDLVARDRAYQESPRRTQDQQFWADYLRDCPQPRGLAHAQPAPAGPVLRRSGWIDGATARLLTERAEACGTRWPLVVVAAWAAYLHRMTGEREVVVGLPAAARRDPHDRVTPAMVSNLLPLRVRVDSGVGVTALVEQVAAQARIVLAHQNYRVEDLRRDRSPGAELIASRANVMSFAYGVSFGDARARAYNLAGGFPEDLAMLVWDRRDGEDYRVDFDANPRRYSAPDVVGHRDRFLAFLTRFATADPPVEPARLDLLTDADRAATARWAGPGPAIEAATLAELFAAQVTRTPQAPALVGDDTTLTYAQLDAVTDRLARSLLARGVGAEDLVALAFPRSVHWVTAMLAVTKTGAAYLPIDPAYPADRIRYMLTDARPVLLLSSAETAATVPCAGVPVMILDSADPADPAAPPARPAPARPAGADNTAYVIYTSGSTGRPKGVAVTHRGLAGLAAAQGERLCVRPGDRMLQFASPSFDAAQSDIWVTLLAGATLVTPSADRLTVGPPLAATVAERGVTHLKLPPAALAVLPGDALDGIRVLAVAGEALPESLVARWHTGRRMINVYGPTENTVTATLSGPLTPGGPVPIGTPITGTRAYVLDTRLRPVPPNAVGELYLTGAGLARGYLRRPALTAGRFVACPFGAPGTRMYRTGDLARWTSDGRLVFAGRADDQVKLRGFRIELGEIEAVLSEHPGVRQAVATVREDRGGDRRLVAYVVGDAAPADVRARAAATLPAHMVPAAVVVVDRIPLTPNGKLDRQSLPAPDWSAAGEPARTPRDDREELLCRLFAQLLGVPSVGPGDDFFALGGHSLLATRLLGRIRTVLRAEVSLRELFAAPTPARLAELVAGSRRGPRPPLRPVPRPEAPPLSAAQRRLWFLHRLQGPGATYNMPYALRLTGPLDVAALRAALTDVVGRHESLRTVFAAPDGVPHQVILPADRATPEISRPAGDPGQWLSRAAHLPFDLSRDLPIRVHLGVLGPDEHLLLMVLNHVAADGWSLAPLMRDLSTAYAARLGGTGPAWPPLPVQYTDYALWQSRLLGTIDDPDSLLSRQLAFWRTALAGAPQHLELPTDRPYPVERSGVGGQVPFTVPAQLHRDLLRLAHDHDATLFMVLHAAFAVLLHRVGAGDDIVIGTPVAGRADEELDDLVGFFVNTLALRTDLSGDPGFGALLDRVRDHDLDAFAHQDLPFDRLVEALVPDRSTARQPLVQVMVTLQRAADVALSLPGVHAEAHPVHLDVAKFDLTATIVEHVGAAGQPAGLDGRLEYATDVLDRRSGQALAERLLRLLRQVAAEPEQRIGRLDVLDPAERQRMLVDGNATATAVPDGTLAALFAAQVARTPDATAVIGDDVTLTYAALDARANRLARWLIAAGIGPEDIVALSFPRGVRWVTAILAVAKAGAAFLPIDPTYPAARIRYMVEDARPRMVLTVTATEGGLPALAAPVTALDGEEIATALPALPDTLPPCPATPANTLYVIYTSGSTGRPKGVAVTHTGIASLAVAKAARFGLDGTSRVLQFASPSFDAAVWEICPALLSGAALVVPSADRLTVGAPLAATIAEAGVTHLTLPPAALAVLPGDALAGVRTLGVAGESPAAEVVQRWSPGRTMVNAYGPTETTVCATVSRPLTPRDRPAPIGGPITGTRVYVLDARLVPVPPGVPGELYVAGAGLARGYLRRPAMTAERFVACPWGAAGERMYRTGDLVKWTGDGQLLFLGRTDDQVKIRGFRIELGEITGVVAGQSGVRQAIVVAREDRPGEKTLAAYVTEAAGRTLDPQTLRDKLAAELPGHMVPAVVVLDAMPLTANGKIDKAALPAPNTVAAPGRAPRDAREEVLCALFAELLGVPEVGIDDDFFQLGGHSLLATRLISRIRAALRADLTIRDLFTARTPARIGERLTTARPARPALRRMAKKEDAS

SEQ ID NO: 16019 - protein, 2068 aa, Actinoplanes utahensis
MTTLSYAQQRLWFLNRLEGGGATYNMPFALRLTGELDVIALGAALRDVITRHESLRTVFPAPDGVPVQRVLDPGAVAVDLTARDTSDATLPQLLAEDGRRPFDLAVDPPIRIRLFATGPDEHVLLLVLHHIAGDGWSAGPLMRDLSEAYAARRTGQSPGWDELPVQYTDYSLWQRELLGEEHGILAEQMDYWRTTLAGLPAEITLPVDRRHPAVPSHRGGRVALTVPAERHRDLLRLAAQTDSTLFMVVQAAVAALLHRLGAGTDIPLGTAVAGRTDEALEDLVGFFVNTLVLRTDVAGDPTFRELLTRVRETALGAFAHQDVPFDMLVEDLAPARIPGRTPLFQVMVLLQNNAVAQLDLPALRVRTEPVGLGVAKFDLTVNVEEQSDAAGRPAGLRVLLEYAEDVFDRATVQALAGRLDRMTAAVAAGPDRRIGRIDLLTAAERDLVLAGGNVTGTPLPARTLPAMFAVQVARTPDATAVIGDEVTLTYAELDARSDTLARWLVGRGVGPEDIVALSFPRSVHWVVAQLAVTKAGAAFLPIDPAYPADRIRYMIDDARPVLLWTVTETAATLPDLDVPVIPLDSSGFADQLTASPTDPITPAATPANTAYVIYTSGSTGRPKGVVVSHAGIAGLVHALTDRYGIDAGSRVLQFASPSFDAAVADVCPALLSGAALVVPSAQRLTVGAALAATIAETGVTHVTMPPAALAVLPEDALAGVHTLVVAGEAPSDEVVDRWSARLRMINCYGPTENTVVATNSRPLAPGHGPAPIGGPIAGTRTYVLDARLQPVPPGTAGELYLAGTALARGYLGRPDLTAQRFVACPWGPPGERMYRTGDLAQWNTDGQLTYLGRTDDQVKIRGYRIELGEITKVVTGHPGVQQAIVLAREDRPGDKRLVAYVTPTHGHHLQPTQIRAHAATALPEFMIPTVVVLDTMPLTTNRKIDKAALPAPDQLTTDGGRGPRTPAEHILCGLFAELLGVAAVGADDDFFALGGHSLLATRLVSRARAALGVELPVRAVFAAPTPARLAAAAEATAGTARPALRPMALPDPLPLSAAQRRLWFLNQLEGPNATYNVPYALRLTGDVDAGALRAALHDVVVRHESLRTVFPATGGEPRQVILDPADVTVRLTEKHITETGLRRELAHAAGVRFDLSQQPPLRAWLWHLGPAEQVFALVIHHIAGDGWSTAPLLGDLRTAYAARLAGTEPGWAPLPVSYADYTIWQRDLLGADSDPDSLLNRQLHYWTQALDGVPTELDLPFDRPHPAVASHQGGHIRLHLDAEVHRALLRVARQSDSTLHMVLQAAFAILLHRAGAGDDLPIGVAVAGRTDEALDDLVGFFVNTLVLRADLTGTPDFTELLARVRETALNAYAHQDVPFDRVVEKLAPARSAGRSPLVQVLLTVQHTAHADLGFPGLSGRAEPVALNVAKFDLLASFVEHGTGTEPEGLTGALEYAADVFDRSTAQALADRLTLILRTVAADPRARLDRIGALPADEHQRMLAAGDRSSPPPAGTVPQLFAAQAARTPDAPALWAGGTTMTYAELDARANRLAHRLIAAGTGPEVPVAVLMDRSPGLVVALLAILKAGGAYVPLLPGYPADRLSWIVAQAGATVLLVDPDLADTRFEHGATVLVHADEPGPGHAPDVRVHPDNLGYVMYTSGSTGRPKGVAVRHRDIVALAADHRWAGGAHDRVLCRSPHAFDASTYELWVPLLRGGTVVLAPPGEPDPRLLARTIADGRATAAFLTTALFNLMVEEGVEHLAGLREVLTGGEAASPRAMRRFLKNCPGTVLSHVYGPTEATTFATGYPMTDSVALPADDVPIGEPLDGMRAYVFDRHLQPVPAGVTGELYLAGAGLARGYAGRPDLTAERFVADPTGRTGERMYRTGDLVRWNTDGQLVFVGRADGQVKLRGFRIELGEIEAVLAAHHDVGQTVVVVREDRPGDRRLVGYVTPGRAGRPVSATEVRAYAVAHLPEFMVPAVVVPLDALPLTTNGKVDRAALPVPDPAASGTGRAPRDETEAILCGLFADLLGVPTAGIDDDFFSLGGHSLLAVRLTARVRTALGAEL

SEQ ID NO: 16020 - protein, 1440 aa, Actinoplanes utahensis
MRPARPPLAAAQRRLWFLHQVEGPSATYNMPVVLRLDGVLDPAALRAALDDLTARHETLRTVFADDGGVAYQRVLDPAQGRMPMTTLRVAASGLPAALADATGHRFDLATEVPARAWLFEVGPREHVLAVVLHHIAGDGWSTAPLLRDLGQAYTARALGRTPDRGALPVQYVDYTLWQEALLGTRDDPGSLISGQTEYWRTALAGAPDELALPTDRPRPAVPSHRGGHVPFTLDDRLHRAMAELARHHDATLHMVLHAAFAVLLHRLGAGDDLPIGAPVAGRADEALDDLVGFFVNTVVLRTDLSGDPTFADLLGRVRETALDAYTNADVPFDHLVERLAPNRSLARQPLFQVMCVLQNNATGDPDFGGLRVRREAGGPPVAKFDLTATFAERTGEQGGPDGITGVLEYAADLFDPGTAAALADRLVTVIETVVAEPERRIGRVQVLTGAERERVLVTWNDRQAPVRPGTIGELFAAQVARTPDATAVIGDEVTLTYAELDARSDTLARWLVGRGVGPEDIVALSFPRSVHWVVAMLAVTKSGAAFLPIDPAYPADRIRYMIDDARPVLLWTVTETAATLPDLDVPVIPLDSPGFADQLTASPTDPITPAATPANTAYVIYTSGSTGRPKGVVVSHAGIASLAATTGDLYRTGPDSRVLQFVSPSFDAFIHDVCPTLFCGAALVMPSAERLTVGGPLATTIAETGVTQVTLPPAAIATLPAEALDGVEALVTAGETASAEVVDRWSTGRRLYNAYGPTETTVCAAISTPLRAGVWPPPIGAPVLNSRAYVLDARLQPVAPGATGELYVAGTGVARGYLGRPDLTAQRFVACPWGPPGERMYRTGDLARWNTDGQLTYLGRTDDQVKIRGYRIELGEITKVVTGHPGVQQAIVLAREDRPGDKRLVAYVTPTHGHHLQPTQIRAHAATALPEFMIPTVVVLDTMPVTSNGKIDKAALPAPNLDVRPGRAARDAREETLCRLFAEALGVPEVGIDDDFFALGGHSLLATRLTARIRDTITEHVSVRDVFQSRTVAALAETLAGVTRSAGAALTADARLDPAIVVGGPHRRAEPGRILLTGATGFLGAFLLAELLRAHPDARIDCLVRAGDEVAAMHRIEHSLRRYLLWDDADRTRICAVPGDLEQPRLGLSRDRFDELAASVDVVYHNGARVHLADPYQRMRAANVDATTDVIRLAARRGIPLHYVSTTSVLYSTTDTPPLLTEDRHVPADQVPANGYIQTKWVAEELVREAGRRGLPVAIYRPSRISGATATGATGDGDAFWNMVRACVEIGAAPDRGRLADVDLVPVDYVAAALVRLSHTVDLDGTAYHLVNPVHTRPADVFAAVRAAGYPIRGLSGAEWVAALTDAARTAAPGSSIPGVALLHGGTSGESLGTEPRFDDSNTPRGLTGSGIQCPIVGPDTLRRCVRFFASTGFLPEERS

SEQ ID NO: 16021 - protein, 405 aa, Actinoplanes utahensis
MSQPLVLRNRAFARVWAAQICSQVAGRMFQAGIVWWVVSEVAASVRGRATGPFMMLASLPAVLLIPVVARALARYTSRSVMRTAELAAAAVTLVLLGWALLTDLPMAAPYPAVFLLAVTQCFFNPCLTKSVPELVDAGDIQHATSFEMSTQSIAGLVGAVAGPYLIHLGGPAPLVAACSGAFLLAALLIHVAGFRTGTAPRPSAPGGPAPAPRKLRAVLADLPFVRTVLICFAAANLFATAGAVIYPLYVRGVFGDDPGVLVLFQVAIGIGMLVGSFSGPHVPGRPTTLGPLCLLGIAAGLTVPGLVVNRMLTSVALLGVGWCAGVLGVKFVTLFQHTVPAADKPVFFAAMQALMTATFPVASIAFGFLGDLLEPRTLCLVQGIGLLPAALALLTTRDREPVPVS

SEQ ID NO: 16022 - protein, 344 aa, Actinoplanes utahensis
MSSVSVVIPCYKYGDYLRACVDSVLDNPGLDIRVLIIDDASPDDSASKAHAIAAADPRVQVRVHTENKRHIATYNEGLLDWADGDYVTLLSADDMLTPGALNRAVALLDANPNVGFAYGHPVHFQHPGPPPPANRGTGGTVVYPGHWWLERRFREGTGCITSPEVVVRTDLQRKVGGYDPQLPHAADIEMWMRLASHADVGYVKADQAYYRLHAKNMHADAGAIDDLRERKIAYESVLRKCGDLLPQRDELDAMVHARLARFALRRAFRAYDRGRTAQTPEDELVAFAAEVWPDYRRLPEYRALALRRRVGAKTMPYLQPLVLSAVGAKAQEWLWWQSWRRRGI

SEQ ID NO: 16023 - protein, 1107 aa, Actinoplanes utahensis
MRQELLGDLRRVVEQRGGNDRRGAHEETGSTTQMISLGRKKLEVIKRLVSGALSALVAGAVVLPPAAVLAADDPCGVNSNPIVCENSKPGTPLEDWYGDASWGDIGGFTTKVSVQPGETLQMKVNSPDSTFTVTIYRLGYYKGDGARRMPTSPTTTFPLKNQGGCDSDATGLVDCGKWTVNATWAVPSDAVSGVYLAVFDQGDGNGYMPYPFVVANDNSHSDIVVQTSDETWQAYNKFGGQNLYEGGGPAPDGRAYKVSYNRPMRIAGDNGVLASEYPMISWLERNGYDVSYASNLDVSTKPALLPKHKVYLSSGHDEYWDQGIWNNVKAARAAGVNLAFFSGNEAFWRTRWEPSISAGGGDHRTLVSYKTTKTKQTPVNGVPDPSGQWTGTWMDPSGAGTGGNAPQNQITGTLFSVNGYRNDAMTVTSDFKKLRLWRDTRIPTLNDGEKVTFPVGTLGYEWDSDVDNAVRPPGAIRFSATTLQITDGTMLLDEGNNYGNGVATHSVVMYRDATSGALVFGAGTVQWSWGLSTQHTGPATVEDIRMQQATANVLADMNAFPKSFQTNLVYPSKTSDTVGPAVTVTAPVGGTTVPKLSPITITGTAADTGGQLGRVEVSTDGGTTWNATVGLANWTYTWTPVTEGAATIKVRGIDDSLNFGTTRTVNVTVGPQQCPCTTYTPSTVPANVDSFDGSANELGAKFQVAVPASVTGVKFYKASTNTGTHVGKLYTLAGKLLASGTFTGETASGWQTLTFSKSVSIAANTTYVVSYYTPTGHYSYTSGYFSTKGAGDGIVKQLQSGVAGANGVYRYGTDGGFPNLSWGDTNYWVDAVVETSAATTTPPKVTVKSPADGDVGVARNAVVTATFDHDIDPATIAFTLTAGGVNVPAKVAYDDTTRRATLQPDSALAASTAFTASVKATDLWGNAMTGATTWSFTTGTGVSCPCTVFSPSSTPDVESAGEAASLELGMRFTSAIDGYVTGVKFYKGDRNTGTHTGTLWSATGQQLATGTFTTESGSGWQTLKFATPVAIDAGTPYVVSYHTTVGFYSYSSGFFSADHTSYPLTGVADAATGHNGLFIQSAGTAFPTSTWNANNYWVDAIFSTTAQ

SEQ ID NO: 16024 - protein, 266 aa, Actinoplanes utahensis
MPSLKKRLRDRYGWLPLEELRNKVVLGHTAVGLARFERAEVRRLLPTLPGGVRPRARVAVIVLTYQRADGLARAVESVLAQTMKDLVLIVVDDAGGQVPDLPPDPRLHTVALRHNINVPGVGRNVGIGLTDSDHVAFLDDDNTWDEHHLETALARLDGPAAPNRPDAVYTAMRRIMPDGTVRDVLSVPFDRRLAWERCYLDNNPLVLRRLPATRFSRLRRTTSVAPKEDWELVYRFSRRHRVEHIPEPTVNYTINPDSYWTPWELP

SEQ ID NO: 16025 - protein, 497 aa, Actinoplanes utahensis
MTDLNGRVATAARWSLVNTIVRRVGTFASGVVLARLYFGPYEWGLYAVGLLVLAMLLSLNEMGVSLALVRWEGDIRRFAPTVLTLSTLSSSAFYVVLWFAAPALARALGSPDATTMLRVLCVSVIIDGIACVPLGQLNREFRQFGRTVVDILNFVVNTVATIAFAAAGVGAMSFAWGSLIGNLVALAGFGLCAPGMLRFGWNTEQAKRLLRYGFPLAAASLLTLGIVNVDSVVVGSVLGPAALGIYAMAFNMSSWPVRMVSETARRVSFAGFSRLADSSPDEFATGFVRAFTLVIAAAVPICVVLGVLAGPIITFVYGDQWAAAALPLQFLVALGLLRTAVELAYDCLATRVRKTLMVMQAWWLFSLIPLLLIGAHLWGVRGVAAGHVVVAGLLVSPVFVVVLGRLGIPAGRVLIACVRPALGGLAMGVVAWLAHRWLGGGFLGLAVAGVASLATYLPFVLPLINRLRAEPSSPSAPSSPAEPDPVVPAADPVADPV

SEQ ID NO: 16026 - protein, 460 aa, Actinoplanes utahensis
MPTGSTAAEARRTTREPHAATVTDRRPGRLYRSQQRLRTLGPDSLLATYIVLLLVVPARLVVASIGATGTVANLFLLVSLLWYAISWLMRRVTPAPFTRVPRLALLFYVVAILLAYVAVGRRDADAAEYSAADRALLQLLIWLPLILLTTSLTEYRQIERLLKLFVRLCTWVAVLAMAEFVLKQSLTAWIVIPGLSSNAASELVARGDFVRPTATASNTLELAATLCIALPFAIQQALYDTDGRKPWKRWAPVFVIALASVMTVSRTSVIGLVLVFLVLVVTWPAGRVGKALLLMIPALGATRILVPGLVGTLIGLFSAMFNGGDNSTNSRTATSADVGEFMKGHTWFGRGPGTFLPDLYRFTDNQYLLALLEIGVVGLLAIVGLYVATIHCGGAGRRRFTDPARRETGQAFVAVGFVMLVVTVTFDTLSFPIVAGSTFLMLGLSGAYLSVARREGDSPQ

SEQ ID NO: 16027 - protein, 305 aa, Actinoplanes utahensis
MDLGEILRVLRNRWLIVVPMLVLAVGLGITTYLMVPTTYSTYTMVSLLSAPAATKAATEGQDNPFLNFNGSLVATADFLGRRLQSTDTQLELRADGITEKYVVALAENAQGPFLTITLTGDDQEHLLASATRLAQYADKTLTEIQQQNNVAEKDRIKLTQVIPPQKPQVETKAKLKLVIVAGGGTAALGFVAAFAVESISRARRRKAALAASEAAEPPVSTARPAAGSAVASPDIEGTVVLQLPPKNEPRMGVAGSSAAASVDVEKTQRIQVPPPRQGGGLATTYQSNGNAVDRRGKDANRVNGS

SEQ ID NO: 16028 - protein, 224 aa, Actinoplanes utahensis
MFLSDMAGVLKRRWYLIIVGAVLTAAVASPAVHTRDRFLASEVLMIQPPVSPYAPNPVTGLYPSIAVTAAAIANRLNTPDSQAMFRAKGVTGTYRFEPRNTGTRQEPRYVIGSMSITNTSSAEADALASLQVLSSTYEQELKAMQDEWNVKRDLRITVATLVPPTSTLLTHSPLRSLVGVALLGALLTAAVTLWTDELLRRRRSARLSTADSPNWTDPLVRSAH

SEQ ID NO: 16029 - protein, 414 aa, Actinoplanes utahensis
MGKRPSVAILVANLPAEKDRRVIRECLSLEAAGYDVTVIAPRGDRSLTILPGSERTRLRPYPIVVYGSGVLSFAVEFFWSFLWISIRLLGEILRGRAQAVQVCNPPDIYFPLALLVRALGRPWVFDHHDLSPEVYVSRGGEPNPLVSRLLVAFEWATLRTATAVFATNESFKDNAVRRGVRPEKVTVVRNGPAFAEIASSDGPADGPHRVVYLGVFGPQDNVEGAVLAAEELIGLRGRTGWKMILAGDGETAAGLRELTAQRGLGDVVEFTGWLGGPEVDALLREATVAIQPDLPTRMNQLSTMAKTVEYLGRGVPVVAADLIETHATVGDAGLYVPNGTPEEFAAAIDTLLDDPDLRAGMRKLGRERFRDSLSWEHQAVQYIAVWDRLLRRGGTPRIPAQRQPSSAPSRVDAP

SEQ ID NO: 16030 - protein, 220 aa, Actinoplanes utahensis
MPEQFNILFHGIGTPRRDLEPGEDQYWITEDAFHAILDEVAAWPAVSLSFDDSNSSDIEIALPALLDRGLTAEFFVLAGRLDQPGSLGEADLRDLLKQGMAVGTHGMHHHPWRGLTADTTRSELADARDRISAVIGRPVTRAACPLGRYDRGTLGALRRLGYTTVFTSDRRPARPGRWLQPRFSVYRDDTPSTVRAATQGSRRLPVRLRNAAAGVVKRWR

SEQ ID NO: 16031 - protein, 305 aa, Actinoplanes utahensis
MVQRQHRGMLALGAAVLLWASFALTVRGIGGSGLTAMDAALLRFGTPVVLLSPWLPRAVRAVRRERPTTIAALLLAGLPHYLLSALGGRLASAAVVGLLLPGTVPLFVALLKRDRRRWPALAAILLGVAVLTVAHAGLAGIAVLLAAGLAWAVYTMALSRTGLDLISLVLVVCTPSALIALAGSAHLKAAPAGTIVLFVVLQGVGTGIVSTLSYAYAVRRLGSSIPAVTGALSPVLTTLLAVPIFGEGLTAGAAVALLLIVGGVVAYNAPQRQRLTTPAAALRSRTGSRRDPWVAARTVDGVSSR

SEQ ID NO: 16032 - protein, 184 aa, Actinoplanes utahensis
MLSLDHAARLGILQAQPIASSALNRPPGGRICYVDSIDRRILLELQKDGRLTNQELADRVGLSPSPCLRRVRQLQDSGVISGYTAVLSAEALGLTITAFARLTLLSHTSTVVDEVEARLRAIPEVVEAYLLAGDDDYMVKIVVASFAAYEDLLRRELRAIPSLGSITTSFAFAVTKPQSPLPMP

SEQ ID NO: 16033 - protein, 60 aa, Actinoplanes utahensis
MTLADLLSPGTIVPTAALAGAAFLAVRALKARMVRVVRVIDRNGKVHEMREDDPRISGHL

SEQ ID NO: 16034 - protein, 307 aa, Actinoplanes utahensis
MTILVAVVSYNSARLLPDLIAGLRTGLDGMKWHLTVADNASRDDSVAVLRELAPEATVVEMGRNAGYAAGINAAVAASPAYDAILVLNPDVRLTPGCVPRLLAALRVPGTGIAVPHLVDGSGALIHTLRREPSVLRTLGDAVLGARRAGRFRLLGEVITDERAYVSQGVTDWAEGSTQLISAECWSRVAPWDESYFLYSEETDFALRARDLGLRTRYVPDAHAVHLEGDSRVSPGLWALLTLNRVRLFGRRHGPVRTAAYWAALLLRESSRAALGRKPSRAATRDLLTPSRLRETPGPASVARVRAS

SEQ ID NO: 16035 - protein, 355 aa, Actinoplanes utahensis
MKVSVVRPDELGPGELAAWRQFQKDQPGLQSPFLAPEFTLAVARQRPTARVAVLEDSDGIAGFFAYEVRNRVIGVPVGFGITDCQGVVHRQGWDFDPTALLRACKLPVWEYDHLMAGQFGRFHTAVAGSPLMNLTDGYAAYVEDRNRAGDVVKQTLRKQRKMAREVGDERFVWDDRDPVALAALREWKSAQYRRTQQYDRFATPWIEGVLDELRASDADGCRAVVSTVYAGDRPVAAHLGLRSENVLAYWFPSYDQELSKYSAGILLCLRMAEAGAADGIRLIDLGKSEALYKTRLKNDETPVAAGRAGRGAVATARRAQTALTRTVKQGALGEKLKSGRTGRVLRGLKARLASR

SEQ ID NO: 16036 - protein, 449 aa, Actinoplanes utahensis
MTARPRLTVIGTGYLGATHAICMAVMGFEVLGVDVDSRKIERLAAGEVPFFEPGLPELLTKALESGRLRFTTDFAEAGAFGDVHFVCVGTPQQAGSEAADLTHVDAAVTALAAHLTRRTLVVGKSTVPVGTAARLAGPLRELAPAGDQVELAWNPEFLREGFAVDDTMRPDRLVFGVTSAWAEDRLREAFQPVLAQDVPVKVTDLQTAELVKVAANSFLATKISYINAMAEVCEATGADVHDLAEALAYDERIGGRFLRPGLGFGGGCLPKDIRAFAHRAEELGVGQAVGFLREIDGINRRRRARTVDLVVELCGGHVAGKRVAALGAAFKPNSDDIRDAPALDVAATLHRMGAGVVVYDPAAMDNAKRVHPELTYATNALDAARDADVVVLLTEWNEFRDIEPSAMAAVVRGRRIVDGRHALVPAHWTAAGWEYRALGRPTFAGTSNA

SEQ ID NO: 16037 - protein, 498 aa, Actinoplanes utahensis
MQTIESLATVDLSERASQVRRGKRAGETRAGWQNRYARMLYLIDYVVGLGAACWALVLRFGPDGSEPNMKGYVLLTALLPIAWIVCLSANRAYEPRHLFVGTDEYARVFRAGLALTAALAIVSFAFDLRLARGYVSIALPLAIVVDLGARYLYRQRLHRSWGRGNRLHRVLLVGHEKAVSDMTRRLRRERYHGLGVIGAVLPATPTPKTFAKGMPPVYGTFDAVDSAVTRADADTVIVLACPEIDGPALRRLAWQLERDEIDLIVASTLVDVAGDRTTIRPVDGLPMLHVEHPKLKGSARFLKATFDRVGAIALLGLLSPILLVVSALVRWGRGGRGPVIFKQERVGKDGRTFMLYKFRTMVVDAEARLAELKELNEHDGELFKIRNDPRVTPIGQWLRRFSVDELPQLLNVVKGDMSLVGPRPPLAAEVAGYPADMLRRLVVKPGLTGLWQVSGRSDLSWEESIRLDLSYVENWSLAMDLAILFRTVSAVVRSSGAY

SEQ ID NO: 16038 - protein, 203 aa, Actinoplanes utahensis
MKVRPLSIEGAWEVTPARFGDDRGTFLEWYRFDHLSAAVGHRLDLAQANLSTSARGVVRGVHFADVPPGQAKYVTCVSGAVLDVVVDVRAGSPTFGRWEAVTLDDTDRRAVYLAEGLGHAFCALTEGAVVAYLCSATYRPGHEHGVHPLDPELGIAWPAGTPLLSPKDAAAPSLSEALAAGLLPRYDTCRDYVETMRRDDDSE

SEQ ID NO: 16039 - protein, 400 aa, Actinoplanes utahensis
MGPVLGCGDDQDLPNSGGDQCGQRVVHHRFVKNWHQLFRHGHGDGPQPGAGATGQQDSAHRRRLNTVEAVVHSAAVQILVTGGAGFIGSAYVRAVLKDEFAGAVGARVTVLDLLSYSGNRANLPVTDSRLTFVQGDITDADLLRDLLPGHDAVVHFAAESHVDRSISGAVPFVTTNVLGTQILLDAARSAGVGRFLHVSTDEVYGSIDDGSWTETWPLAPNSPYAASKASSDLLALAAHRTHGMDVVVTRCSNNYGTHQFPEKVIPLFVTNLLDGKPVPLYGDGGNIRDWLHVTDHVRGIQLALEKGRAGEVYNIGGGTELSNRELTGMLLEACGAGWERVTRVADRKGHDRRYSLDITKIKDELGYEPQVTLHDGLAATVAWYRENRAWWEPLKAKAGL

SEQ ID NO: 16040 - protein, 287 aa, Actinoplanes utahensis
MGAAEGEGRALMRWLITGAGGMLGRDLQAVLDGADVIAATRADLDITSPDQVRDAVAGVDVVINAAAWTDVDGAETATEAATAINGHGAAHLAAAAGRRLIHVSTDYVFDGTATTPIPEDAPRSPINAYGHGKAIGEQAVLAAGGSVVRTAWLYGRHGPNFVRTMLRLAETRDTVDVVDDQEGPPTWSYALATQLVALARSGATPGIYHGTAAGSTTWFGLARAAFTAAGLDPARVRPTTSARFVRPARRPAYSVLGHAGWSGTGVDPLPDWRDMLTTAMPALLTSR

SEQ ID NO: 16041 - protein, 128 aa, Actinoplanes utahensis
MLAMSAAFVGVWAAGFPVSFYRDFPWAGAHWVSALGPYNEHLVRDVGGLYLALLVVSVGVVRRPTLRRVAGGAWLVFSAEHLLWHALHLDAFSRVHQVTSMVALSVPLALSALLLRPERGVSAGPRDT

SEQ ID NO: 16042 - protein, 250 aa, Actinoplanes utahensis
MDVMRIAVAGGTGWLGKLVVAEAERAGHEVVVIARSRGVDLVSGNGLTDALRGVDVVVDVSNVQTLSGRKATEFFETVTRNLLNAERRAGVRHHVLVSIIGVDRVEWGYYQAKLHQEQIALNGPVPATVLRAAQFHEFAEQSLTRFGGPVAVVPAMLSQPVAAREVAVELVRLAEGEPAGLAPEIAGPEPLQMADLVRRVARTRGPRKWVLTATMPGKAGRAMATGGNLPATPGLRGTQTFDQWLTESRA

SEQ ID NO: 16043 - protein, 400 aa, Actinoplanes utahensis
MPSQPVPPATAIRITSTSLRCVHQEDRSGRRNVTASAVTQLTTPESGSGVRRNPYMAGRRGGAAAATHPVSPPSVVADTRRQPADQERSLDAARRTGPPETLARRSRSERGPPAAIRIDRRRRWWLTDRGPKASPYCRRRGRERGRTAGGEAGSGAVLPGARPGAGPYCRGREVRWDGGRRGRRRRAGRPRGVPMSGRSRRSPGRGGRTGCFDSRVEITTWYLEQTAPGPATAAAPAVPVRVERAEIPSPELSRFLYTAVGGDWNWTDRLAWTWQQWHDHLARPGVQTWVASVRGTPCGYFELDGTRPGSVEIVYFGLLPSFTGQRIGGFLLDAALARAWALNPSVARVWVHTCSLDGPAALPNYQARGMSLYRTETTTVPVPAEPPGPWPGAHRETAAK

SEQ ID NO: 16044 - protein, 1604 aa, Actinoplanes utahensis
MSEEVVYRSDRTRVVRRHSPALIAKQATGPGAHRRTEHERAVLTRLAGLPGVPRLAAGQQRQTLMLIDDGGAPPPPGPMPVPELVDIAIALAGTLAAVHRAGVLHRDITPANVMLTRGRPVLIDYDLALTGPPEPDEAPVGTLGFLPPEQTGRTALPIDRRADLYGLGATLYTLATGAPPFPTGDPLALIHDTLIRIPGPPGLPGRLDAILLRLLAKDPDDRYQSAEGLAHDLARFRDDPNGRWVLGDRDFPAVLCAPEAPLGRAAEIGELAAALDRSSAEPTPAVLISGPAGIGKSALIHTLRPLITARGGWFVSGRYEQSRTGTDTGGIARMVRSLGRMLLAEPEWELTEDRRRILAALGPNASALAAVVPEMAALLRVDGLPYQGDPLTTAARLATTIAGLLRAVAVRRRLVVLIDDLQWASASSLRILDGVLADGPVAGLLMVAAYRDEQAGDDDPLGVMVTRWQRDGLAGAPLRLDGLDRAGRAALTGTLLRLPPDDATELAELLAGAGGGNPYAIVELLNALRAENLLTPAAAGWHYDPAEVRSFVARHRLPQLLAVRLRQQPESTRLLLTALTCLGADVTADLLATATGIPPESLPARLAPAAADGLIDADDPIRFRHDLLLQTARELLPPAAREQLQLAMARRLAGRAEFTRQAAEQYLAVAGAITGDDERRSAAALLHRAGRRTARIANHLVAEELFAAADRLLAPLSGRGDRAARDALAIDRHAALYYLGRHAEADVFYRELTVRCRDPLPLAGATAVQINALTQRGECRAALALGLDALRRFGLVPPADLVADNRRAITELRDRIAAHGPDYPDTEVTDPRTVAIAGIVERMLLPAFLIDPDRHAWLVLQVHTLWQENGVCAALAGAAGSVSCLTIAMLDDYRTGFVLTEHALNVARKHQYQQESAIAAHLHLMISAHWFLPLEELVAPARQTRLDLLAAGDVQMAGVQWARLLSLLFETEESLDASGDEAEAVLAFADRTGNRFARLIAIGHRQMVRDLRGDPPGDDADYLAEIAAFPTAMATHHQRRALTALLNGDPAAVDEHSAVALAGADTIRGLYSCALIRLCRCLSDPAATSDRDWLARRAADAPFNFRPLLLLADAERARAAGDPGTAIRLFDEALLSVGGRPWQHALLAERSARIHLEQGLTHTGRRLLAEACDAYRTWGAGGPVARLEAEHPFLRGTRSDGSSSGTGADRIDLMAILRASRALSSQTTVTGLAAEVAGVLSAMTGATDVRLSLRDRTLSGTADTDLPLSAVRYVRRTRQPLLVADATRDDRFAGDAYLTGLTACSLLVLPVSCHRAEDAVLVLANRRQRGVFATGRLETVELIAGQLAVSLDNALVHDSLESEVRARTAELADRNRDLEAANQLKADLIGMLGHEINNPLATILGYLDLVLTGDDPLPDPVVGLLTRTHATTRRLTGIVEEVLALVSIDAGRLTAVPRPVRVAPHIQAALGVAPASVDCPADLTAAAQPGHLDQILTNLVSNATKYGGGVTGIVARGGRDEVTIEVRDQGPGVPPEFRDRLFARFARADRTAGQVAGTGLGLYIVRELARANGGDVRYRPGRVGGSRFIVTLPPATREAQPDMR

SEQ ID NO: 16045 - protein, 110 aa, Actinoplanes utahensis
MSGYILRGVAFPFPGGRFPERLGAVVQRTVLTGEEPARVVIHDEENDWLVGDGVNDPDLPGASVIACIATIADTDPGLAELATLPVGRIARRDEAGKPWTVDPHTWPDDL

SEQ ID NO: 16046 - protein, 68 aa, Actinoplanes utahensis
MPTVLGVELAAYTSAWYVRHPDGALSAKRSDAPAPAPAEPAESVAGRAAAAAAPERAGGRKVLVAGPE

SEQ ID NO: 16047 - protein, 361 aa, Actinoplanes utahensis
MGWRGCAMRWYVVAVMVLATASGCSSADETTVEQKDRGTIGIAMPTTKSIRWVGDGKNIAQQFQVLGYKTDLQYAEDDIDKQISQIKAMLAAGEKALVVGAIDGTALKDVLAAAATAKVPVISYDRLIRDTPNITYYATFDNFRVGILQGTTIVKALHLAGSGGSHTIELFAGSADDNNATFFFNGAMSVLQPYLKSGRLRVVSGETSFQQVATQRWDNAVAKKRMQRLLAGPLRGTRVDAVLAPNDGLARGILEAVQEAGYAKPPVVTGQDAELDSVKLIAAGKQTETVYKDTRELAKVAVQMTNSLLLGGVPVVNDEKQYDNGVKVVPTFLLQPVNVDRSNYKRVLVDGGYYTADQLAG

SEQ ID NO: 16048 - protein, 523 aa, Actinoplanes utahensis
MIQRFLDLSVRTKLTILVAASILALAVCLVVTTINGRTADSTARDLENLNTASAMVLQLDREASELRANGIQSIVRSDPAKQSELLKARISEVDDLLTRLQAIDLPSGLDAAVGRIKAVTDDYTITLKRFVDAAAVDQAGARLAWEQVDVDNYLISAVLANERALFLDTVARANQNAAQSRATANHILWLAVAIAAILVCVLARLVVLSITRPLQRVRGALQAMADGDLTVAAEVRGQDEVGQMARALDEAQANTRRVVSSVAGSAQAVAAAAEQLTATASTMSRSADQAASQAQTASQAAEGVNDNVSSVAQGTHQMGDSIRDIAHNATEAARVAEQAVAVADATTTQVGKLGESSREIAEVIKVITSIAEQTNLLALNATIEAARAGELGKGFAVVAGEVKELAQETARATDDISRRVQAIQADTAGAVTAIGEITSVIASINDYQATIAAAVAQQTATTEQMSHNVALAASGAGDIAANITGLATATQVSTEGIAQSQQAVTELSQMANNLQTLVSHFRY

SEQ ID NO: 16049 - protein, 158 aa, Actinoplanes utahensis
MLGRPLVFLDVDGPLIPFRARTVGAAPPAPDGGNPLLHRIDPEDGRRLRKLPADLVWATTWMDEANEVVAPRLGLPPLPVVDWPDEAPLPGLHWKTAFLVTWAAGRSFVWIDDELTDNDRRWVAAHHPGRALLHRVDGNRGLTDADFFTVGAWLMIHG

SEQ ID NO: 16050 - protein, 377 aa, Actinoplanes utahensis
MRDGAAATVAVLRTGKEAVSQQPAVTVPLPAPGAAVVLSTTLVERAAEPVLRRLPELAAEALRAAELGRNDIAEVYAVGAAAAMPALPRVLERELGRPVRVAALPGAAVVLGVAEAEGAAAPAGEPAPEVPRLTVLRVLGLILPGAASVALFSHFVFTARGRTASSWGELAIAGVLALMLCLAAGPWIGAALARDAGLRGRWDAAGQISAGLLTADAFGVTVAALYAVAAGLYLVAPFGEPLQWSLLPVLPAALLAAAVAVIVRRRLIPPVIVESPLVATIILSIGSLLYALTVRAGFPPAAALWGTAATRTGGALIGVGVALLLFRITVLRGITAVVLGVFGFFIADPRAVGVFGVGIGIAVAVWWGQRLLTLVRP

SEQ ID NO: 16051 - protein, 73 aa, Actinoplanes utahensis
MLILVDPEQAVEPGDFCIARLGGDEFTFKKLIRDSGQVFLQPLNPQYPMIPCNESCSVVGKVIASQWPEETFG

SEQ ID NO: 16052 - protein, 396 aa, Actinoplanes utahensis
MKSNNALIVILGTVTLDAVGIGLVMPVLPGLLRDIVHSDSIASHYGVLLALYALMQFLCAPVLGALSDRFGRRPVLLASLLGATIDYAIMATTPVLWILYAGRIVAGITGATGAVAGAYIADITDGEDRARHFGLMSACFGVGMVAGPVAGGLLGAISLHAPFLAAAVLNGLNLLLGCFLMQESHKGERRPMPLRAFNPVSSFRWARGMTIVAALMTVFFIMQLVGQVPAALWVIFGEDRFRWSATMIGLSLAVFGILHALAQAFVTGPATKRFGEKQAIIAGMAADALGYVLLAFATRGWMAFPIMILLASGGIGMPALQAMLSRQVDDDHQGQLQGSLAALTSLTSIIGPLIVTAIYAASASTWNGLAWIVGAALYLVCLPALRRGAWSRATST
